United States Patent 12,491,220 (COMPOSITIONS CONTAINING INDOLE-DERIVED METABOLITES AND METHODS OF USE THEREOF) - sequence listing, part 9

SEQ ID NO: 12 - DNA, 3976469 bp, unidentified (residues 1,988,236-3,976,469 of 3,976,469)
  source 1..3976469: mol_type = genomic DNA; note = Bacillus velezensis
tgcctgtcacaatatcttccttatccgtatatttgcttaaaagcaccatatagcagctcagcataacggtagacaaatgaatcgaacgggatgcggcgaacgccgttagattattcagcagccgttcgggaagacggcgtgtcagcgtatcttctgtaaactccggaacgctgctgtccgtgcgcatcggcggaagctgaaggtcaggcagatcgcccccgagctgtttcatccagtaagcgcgggcagctttgctttcttcacccgctaaataccgcttttcccaagccgcgaaatcggaatgaatgccgggagcggcggccgtaaacccttcttttccctccagcagcgcctgatagtgatccagcagactgtgaataaatgtaatggatgaaaaaccgtcaaacacgatgtggtgaatgaccgtcaaaagataatgttccgaggcggattttgaaagcagccgcacgcgcagcaaaggcccgccttctttgacaaacggctctttcacttttttccgtatcagagcgggtatttgtgattcattgacgtcagaaatatcttctcccgagaatacaaaaggatctgccgcttctatgaaataaaacccgccgtctgtttcattcacggcgcttttgagcatcggatgctgctttaatacgagctgaaacgcctgtttcagtttctctttgtcgattccggttgtgaatcggaaacagagcgggacatggtatgcagtcgtttcaggcgacattttctgcaatgtccacagccctttttggacttctgaaagcgccggcgccgtttgccgtctctcccgttctgccggcggttcggctttttgggaatgatgctccgctgacatgtttgccgctttttcagcagtataagccgctaaagcgccaatcgtcgggtttttgtgcagctctcttgccgtcagccggatgtgatacgttttttcaattgatctggcgagtttcatcatcttgatggagttaacgccaaggctttgaaacggtgtatttggatcaacaagctcatccgcgatggaaagttcctctttcagaaaacggataaaatcccgttcaatttctttctctgcagaagccggggctgaattgccgccttcttgtctgttattatgtaatgaatcaaattgcccttgttcgaatgaatgtttcagctgagtgcgctggattttcccgattgccgtcttaggaatgtcttcttttgcgaccggaagcagataatcaggggtaacgccgattctctgtgtcacgtgctggtgaatgtgatgaagaagcttcgtcatgcggttctcatccaatggaacagacgtcacaaagaaaatcgccagctcatctgtcgtgctttgattcggccggacggcgcatgccgctgtatatgacgtttcaatttccggcaattcctcaacggctgattcaatggcgtggctgtaataattcacaccgttgataatgatggcatctttcgtgcgccccgttatcgtcaggcggccttcacgcagaaatccgagatctcccgtttcaaaccagccgtcttctgtaaagacactctcatttaagtccgggcgctcataatatccgctcgttacagtcagaccggacacttgaaagcggccgatttctccttcttccaccacttgattgcggtcatccgtaattctcatattaaaccccgggatcggcagaccgatctcgacgaaacgatcgtcgtcactcgtgttttccagtgtaaactcatctgagaaaataacgcccgaagacgtttcggacattccccatgcgggacggatggcattaaccggcagaccgtgcggctctaaaagctccataattctgcgtccgactttcgccaccgcggcctccccgccgttcagcatataacgcatggaagataagtcccatttccgcgtttgaatctcttctgcgaaatcggcaagcagcccaaaggcaaaattgggggcccacgtgaccgaagcgcggtaatgatcaatcaggtcgagccattttaaaggatccatcaaaatggattcgctcggtatgttgatttcctcacatccgagataaacatcacgaagatgaagcattccgatgccgccgacatggtcaaaaggcatccagttaaacgtgacatcctcacttgtatagccctgcatctgaatatttcctttgaccatgcagacgatgttttcatggctgagcatcacggctttcggcttgcccgtgcttcccgaggtcaaaagcagcatcgccaaatcttccggacggggatgatgacagtccgtatccatttcatgcgcactgagatcttctgccgccaaagcgcaaaacccggaaagctcctgctcctccgcccattcagtcatctccggcagcacttcacggcttgtgatgacatacggctgattcaaaagcgtccaggcgtctttcagtttttgcgtcccgctgttcatttctgtataagccggagcggccgcaagcggaaccgggatcgctcctaaaaaaacacagccccaaaacgcaggaatcagctgggaattatcactgagctgtaatatgacttcatcctgagccttcactcctgattggcggagccctttcacaatcgaaagagcgatctttttcaggccgctgtaagtctggtacactttggtgccgtcaggctgtatatatgtgatgcccttttgatctcccgctgtcgcggcggttttgtgcaggacttcaggaatcgtcatcggctgatccgctgaaagccgcaatggttttccgtagctgacagatggcttgagtaacccgcttgccttcatatcacttttcatagagctgcctccatttcatctgtatgtaagatgtatgtcttatactccgtacatcgtcgtgattcgttttttcacttcatcatcatgaaacgtctcatcgtgcatgattaactccttctcaatgacggccggaagctgctcgcgaaacggcgtcaccaagtgccttttcaatgtaattaaagagtttctcggtttttccgaaagctcacgggccaattcctgcgcatagtctaatacttcctgccgcggaagcaccggaaaaggcactcctcttttctccaggtcaccgccgcggtagtggccgccgtttaacagcatttcatggccgaggcttgccccaagcttctccggaacgataaaggtagcccccattccgggagtgaaaccgtatttcataaagtttgcggtatacacgctttctttgcttaaaatgacaaaatcactgaaaagccccatgacaaacccgcctccgattccgtggccctgcatggctgaaataacggggatatcacattccagcgccaaagaatacatgcggtcttccgtaaacttcgtgatgccctgctgaatcctgagcagaccttcctgtgtgcctccggaagcaaagtaatggccgtatcctgttaaaatcacagctttatagactgacgatttttttatacgggtgaatgcttccatcaatccatccgtcagttctttggagaaagcgtttttatgggctttatcctgcattgtcacttggataatatccggttcaatttcgagcagttcaactgcggcgttcggcatgatatcctcctaactgttctccgtttcccaaggaagccgccccgtttctgcataacggaaaatggctgattggttatccggatctgaaaacatcgcttgattttcggctaaagcaatggatttcgaacgatgaacaaggtcgtttaaggaatccatgtattttttatagcggatgactgcttttttcgacagcgggcgaagacgcagcaaatgctttctcagctctgttgctgagtctgggacgcatacgtcacaaagcccccattcaagcgcctgatgcgccggcacgggctttgtcataatcgtcatataatgcgccttttgaaatccgattctttgaattaaaaacggcagaacgcaggctggataaagtccgaataacagttcagataaactgaacgaagcactctcctctgctatgacgatatcgcacgcggcggcaaaaccgacacctcccgcatttacttttccgcggacgcgggcgattgtgatgtacggcccggattttaatgccagccacaaacggtaaagcggctcctgcgattccgcatgttgcattccctgcctcattttccggtacatctcttcaaaatccgccccgaaacaaaatacctccggctgcccttcaatcactacggaggtcacggagtcttcacattcagaaagaacgtgcaggcattcctccactaaacgctcattaatcgtattgttggcttcaggccgatcaaaggtgatgaagcagacattttgctgaaaacggacgttgatcgtctcataggtcacggcatccacctgtatttccgatgaaattccgtgatttcttccaaatataaacgagggctcccggcatgatggtctaaaatgttcggaatcatattcatatccaatttgacattccgggttccgaacttcaccagaccgctgcctttaaacagttcttcatactcttccatggacagcctgtatctgttgttcagatgctcttctattttgaaagaatgctgccgcgtttgtccttcaggcgtcacaacgccgctgtaaaattccgaacagcatcctgagccgtacgagaaacagccgatccgcttagaagtgtcgaaagccccttggtcaatcgtgcttgcaagagccagtaaagaggctgcccccataatgtttccgactctttggcagtagcggagccccggctctaccctggtttgaaaatcctgttcgatctcagcgtttttcgcttttgcaagcttacgcatcatcgtccggtgagctcctttgaccatgccgccaaacggtgtatggaaggcaagatagtgaaacgtctctttatagtcagcgcccggcacacggtttttgtactcgcgaaatgtctgttcgcagcaatcgagataagacatcaatgacaagtcggcgtcaccggcttcactgtccgggatcggacggcatgtatccatcacctcatagccgtaatagccgttggcgcccgcatccgcctgaaatacgattgggttttcaccgatcaataaggcgacggcacccgctccggcgctcggttcggcgtaagaccaatcctcgcttaacgcatcgccgccttcggcaattaaaaaccgggaaatatccgtcgcgacgacaagcgccttcgctccgggggatgtctgcgacaaaataaaattaagcgccatctgcaaacccgccgttcctgaataacaggcctgcttcagttcaaataaacggcagttccggttgaggcctaaataatcatgaatatatgtactgagtgattttccgaagtcgatgccggactccgagcaggtaatcagcagctcgattctgtctttttcagcctctgtcaatcggtcaataatcggctttgccgcgttaacgccgaatgtgacggggtcttcgtacggaagcgccaccgctttttctttcatcagtaaattctcaaatctggcagggtctaagtttctgtactccgccagctgcatgacatcaaggtatgccgtcccgccaaacacatttatcgcttctattccggcagccgccatgaacttcgcctccaatatgaattttgagtttccgattttttcaccgttttatcagacagcctgtaccttttcataaagctttgccgccaattcgccgatgtttgacactcccgtcagctcaacacgcgggatctgcagtgataattcttcaagcatcatcgtgataatttcggcgcggtccactgagtccgcccccagatcaactaaccggtcttcctttgaaagctgttcgccttctaaatcaggcaaaacctcgtagattgtgttctgcagcaattcaaagattctttcttcactcattgtcagttcctccctgtttcatcttttatgaatattccatgttttcaatctatcatttcgtcttgtcaacacgtttgcagaaatgagcctaacttctgattcaaaagcgaggccgtctcttccataagacgaaggccgataccatcggcatggcggtttttccaggactccagctccgtacctttcacccattgattaaaggcgcctaatgccgggccgcaatgaatctggaagtctaccttggcatccgggtctcctttaatcgccgaagcagagctttgcctgaaataccatttgaatatgagcgccattttctgtttcggattccgttcggcttttgaaatgtcttcattcgaataatgagccttcactttgtcataaatactgcttacacttgccttaaaatacttctcttctatttgtctgagtgtcttttcatcaatttcttcaattgagcggtgacgctgatacagttcatgcagcttagaggcccgggtcggaaagaacagccctttctttaatacctgcaccttgctgcctgattcaaacatatcgccggccggcgcgtaggccgtgtcctgtacattcatctgctgcaggagatcctttacgaggccgctcgtcgctgcttcaacggtgcattggttaatggatccggtcacaataaaatcagcgccgagcataaatgcggccatagcagcctcaggcgttccgattccccctgcggctccgatgcggacggttttgccgtatcggtattttttcatcatgtcatctcgtaaacggatgatcgccggcatgagactgtaagcaactccgccgtcagtgtggccgcctgaatcagcctctacgcagatgtcatgcgcaacgggtatttctctcatcagacttgcttcttcagcggtaattttgttttcggctgcaagtttctgcagaatgtgatcaggcgccgggctgagaaatgcttccgctacttccggacgggacagctttgcgataatccgctgacgcgctattatttgtccgccggcaccgcgttttaaccccttagcgcgaaaccttactaaagcaggagtaaccgttaaaaatgctgatgcttccaagttctgaaccccatgcttcagtaaaagatcaatcattttttcttctgaatctgtatgcttcatgttatgtacaacatttatgccaaaggaaccgccgtcacgaagctcatgctgaattgacaaaatggcgtcctcaacgtgcgcgatgttcaaaccgcccgttccgaaaaagcccatcattcctttttcggccagtttgacgaccatttccttcgaagaaattccgcggtacatgccgccggccaagtaggcgtatttcaattgataatcgcgcttaaactcttcatttcctaaagactccgccgtaattgagctttttccagctttagccgggactttgatttcatctgttatcggctccgcttcagccgtaattctttgaatcagccccgtcagcacttttccgggaccgatttcctcaaagctcatgttctttcttcccattaaaaaacggatgctgtctgtccagttcaccgatcccgttatttgtccggtgagtgtctttttcagctcggtctgctcataaggtcttgccgtcacatttgaaatgaccggaatggacagcggcttaaaatggaaagtttcaataaaccgtgaaaattcctccttcgcttccagcatgtatctggaatgaaaggcgccgctgacatttaagcggtgaaccatttttacgccgtttacggcttcaaaaacggatgcggctttttcaatatcttctttatatccggaaatgacaatttgctgcaaagtgttcatgttggcgatatcaatcgtatgcaagtgatactctcttaaaacgtccgtcacctgctcatgagtcaggccgatcaccgctgccatgccgcctccttttgcgcggctcatcaggtcgcccctttttttgaccagctgtaggccttcttcaaaatcaaaggcgcccgaggcgtataacgcgttatattcgcctaaactgtgtccggcggtaaaatccggtttcaagccggtttcttctgtttttttcaaataactgagggcattgacgacatagagcgccggctgagtgaattgagtctgattgagacgttccccgtcccggcacagctcctgaatggaatatccgagaatgtgatcggcctttgcggttaattcaggatagcagccgaacaggtcctctcccatccctattttttgcgagccttggcctggaaaaacaaagctgatcatcttacagtctccttccgggcggtgataaaatgctgtcttctatttgctgcaaatgggtttgttctttatgaaacggcgtcataatagcacggatgcgttcagccgatcctgcgggaagaatctgtttggcaaatgcggccaacgttccggaaggcccggcatcgatatacaatcctttttggcggctgtctgcgaattgaagcgcttcgcggaatcgaatcggctttcttacaatatcccagaaaaagtccgcttgtatatcggtctcagcctctccggtcgcactggagatgtacggtataaacggagtccggattgatttctgagctaaaaagcgcttgtacggctgttccgcctgatcaaccagcgctgagtgaaacccgtaagataccggcaatagctgatgaggaatctgcttttctctcagatcgtccatgatctttttgatatgttcccgctctcccgagatgacaaagtgagaatgatagtttacagatgccaattcactatgttcgccgagcagcggatcatcttgatataaagccggatcacccagtatcgcaagcatgctggcgtaacggcaagtttccgtaatgattcgggcctgttccagcacgcaatctaaagcatcctcagcgctcagcacacccgacacagcggccgctgcatactctccaaggcttgctccgatcacataatcgggacgtatgcctctttgctccaaagcatatgcaagtgcgtactcagccataaaaatggcaggatggctgaaaagaaggcggtcaaatggatcagacagacgattgcctgtatgataaacctctttcaggacagagtaaccgaaacggctgactgcaaaatcgtccaagtcaagcattttctgccgaaaagcggcgttatgtgcaaacagctctttccccatttgatagtattgggaaccctgtccagaaaacatgaaaacaattggctggttcatttgttctcctttttgctctttatttttttaaaatattgatttgtaagtttttcttgatgttgtgtgcaggtgaagtggtcgtgatgttgtatggctggcactattatgtgagataagaattttgacttgcgttccgctacatggcgggtgaagcttcagtttcttttttgatgcggtgaataagtcctgtcagcacatggcccgggccgacttcttcaaattccatccgccctttgtccagcagatagcgcatgctgtcgttccatcgcactgaatggtcgatctgatcggccagaacggagtggattccgtcttgctcataaggtctggcatgcacattagaaatgacaggaattgatatagcagaaaaatgaaatgactgtaaaaatttttcgaactcttgttttgcttcgctcatatatctcgagtgaaaagcgccgctgacgtttaacggatgaaacatcgtaacgtcctttattccttcgaatacgcttttggctctttcaatgtcttctttgcgtccggatatgacaacttggtgaggagaattcatattggcaatatcaatcgtatgtaatccgtgcgtttgaagggcgtccgacacttgagctgcggttaaccccataacggcggccatttttccgtcagtggccatactcattaattcgcctcttttacggacaagctgcaggccggtaataaaatcaaaagcacctgctgcaaacagcgcattatattctcccaaactgtggccggccaaataatccggctttatgtcattttcttggatttttttcaaatagcttaacgcgtttacaacatataaagcaggctgggtgaactgcgtcttgtgaaggttggaatacggattctcaagacaaagccgtttcatggaatatccgagtgtttcatcagcctgctccgttaagtctttaaattcatcaaacaatgagcttcccatcccctgcttttgagaaccttgtccggggaatatgtatgtgatcattttctcagccatcctttctcggattcagttaagaagcatgttcaagttgatagtaacttcacaaaaataccatgtcaagttaatttatcctatgcggaatcctgaataatgcctatttttccctgacggaaggcggactcagggcttttggaatagatataagcagaatgtcccattcagcctgcccggcgcttttatccgcaaactaccgttactcagccattcatcaccaaaaagcgagcaatgactatcatttcaattcagaagttccgtggcctaaaagaaaaactagttagatagaaccaaattatacgctacttaaagtgaaacagccctttttgattttttctgttgcggaaattcacgaaatgttcttttttttcaatctgaaagtaaatattgtttttcaaaagactctccattttttgacccggcttctccccgaaggagtgccccggatacacacgcacatgcggcggaatagaggctttgatcctctgtatactgtgaaacatatcttcagctgagctgcccctgtcctcacatataccgcacccttctgtaaacacggtgtcaccggtaaaaaggtgatcagatagcaaatagcacattcccccggccgtatgtcccggggtcaatatacttctgatgataaaccctccggctgcaaaggtttgtccgtcttcaagcgctattaagtttctgcaccggaattgatagaaatcgatttccgccgacgacatgtatatatcagaatgatagatttgctgaagcggctccgccaagtttacatggtcataatgcgaatgtgttaataaaatagctgataaatcaacatccaattcatgcagtttatcggttattttatcgatttcccaggacgggtccaccgttatcgcagatttttttgagcggtctgcgataatataacaatagttggaccacatctggtgataagttttgatttgatgcacttcatatgtatgatccattgtcaccattcccatttaaaagatccgggcagactgctgccgccgcccagccgactgtaaccactttaccagatggcaccacgtttttccatggattttccggtaaagtttaaaaaactttctacttccgccaaaagcaccagtcagggccttttttacaaattgctatgctgatatataaggaaatcagaatattaattcagatgaattctttagggaattttattcagaaaatgaaggatgaatatgagtttcggataaaaagaaaacaaattaagcttttgttttgagaagcaattacagaagcggccggaggagataatcagtttttagaaatgacccgcaattaagattattatttcaatccttttcttcagataaactaaaccacacgggctctcgaaatatatcagaataccttagttcttacaccgaattcaacgttatgttgacattaacataattgaactgagaaaagtacagcttaatttacactcttttcttttgcgagaaaaccgttcaaaaacaagtctagctgcaacaattcacgaaagcgtcgcgcatgaaaaaagacgtcagttgaagacgatttatatttgattattgacaaggagctcagatgtttttgttagggctaaataaagttatctttttactgtgccaaaacaaaactaacataaaatcattaagtgtaaaaagtaaatattaagatttagacaaatagactatgttatatgggtcggagtttactgctcaaggtgatttgtcctgagctataaagcactgagagcagctcgggacgcaatacctactaaagttaaagctgctatgggtggaatcggcggttttgaaataattcttaatatcattgacaattttactggtgcagttgaagatgcgtgctatgcggatgctctaaaagtaactggcaaccaggcagcaactttgtgggttactaaaactcttatgcttttcctttaaacggggctattgttggtgtttaacaaatttatcctgtgttaagctttaaagtgattattttctaaagtgtttaagatcggaggtaactatggaagataaaagtaatgctgaaccgagcccgaaaactataagaattctaacttacatcattcctatatttttaatagggcttatccttgttcttaagaatattaacaccgccgcagcggaaatttcattttatattgttgctatcggtgtggttctcttagtggttttcagtttgatcaaaaatagaaaaaaccgcagaaagaactaaatgtaagggggactaattactagtcccccttgactaacttgcggatagtataacccgcccaattccaattttatttaaattcttcacaaacagcatgagatttttcaggaatcgttttctccattatttcactattaatgcagttaattgatgatatagacggttccacaaaacacaggatactacatcgccaaccccaattactacccataaacaatttttatatgacagaaaagcagctggatgttaaacaaattatcttcatgatttacggtataccatgcaacaatcatgccagaaattaaaaaactcaaaagttatgggtcattcaaactagtaaggctgcttgtgggtaaataacggtttagtctcacataaacgttattattacatcacacgcttaaacatcttctccatttcatacgtactgtggtggataatgatcggccggccgtgcgggcatgtgaacgggtctgtcgttcggcgcaggtcgtccaagagcgctttgatttcgtcgtttctcaaatggcggttcgctttgattgagcctttgcagctcatcataatggccgcttcctccctgagttttttaatatcgatctgtttggcgtcaagcacctgctgaatgatttcttcaatcagttcagcttcttccccttttggaaaccaggccggatggcagcggacgatgtagctgttcgtgccgaatgcttctaaaaatactccgacgctttcaagctcatgctgatgctggtcaatgatcagcgcttcatttgccgcataatgaaaggtgagcggcacgatcatatcctgcacttcaggctcgacctgcccgactttctcccggaaatattcgtatttaatccgttcttgcgccgcatgctggtcaatgatatacaagccgttttcgttttgggctaaaatatacgtcccgtgcatttggccgatcggatacatcaccggaactctttcttcccgtatttcttcagagtcagcctcctcttcaggctccggaatatcggaaacaggcgcttccgttaccggcatgccgagctccggcggcactccgtgacctgcttcatccggcagggactcttcttctatgaccggctccggctcttttacgaccgaactcagcttcatcggtgagtaagacggctccggcgttttttcaggaagtttccgctcaggcgcgctttcctcgaatgtcataaattgctgttcgtttttggccggtgccggcgctgtttttttcgggagctgggcgctcggaataagccgctgcttttgaaacacttcctttatcccgtcacggatcagctcatgcagctccgtctctttgctgaggcgaacttcaagcttcgacggatggacattgacatcgaccaaaatcgggtccatcgtaatttcgataaacgtaatcggatggcggccgatcggcagaagtgtgtgatagccctcatgcaccgcttttacaagcggaaaattcttaatgtatctgccgttaatgacagatgacatgtagtttctggatgcacgcgtgatttccggaagcgcgatgtagcccttgacttcaaaatcaagcgagctgacatggagcggtatcatttttttcgcaaccgccgtcccgtaaattgcggccagcacatggcgcacgtccccgttaccgtttgtctgcagcagatttttcccctgatggcgcagacggatggatacttccggatgcgcaagagcaatccggttgacaacatccgtaatattgccgagctccgtatgcacggttttcatatatttcaatctggcgggcgtattgaaaaacaggttggtaacgataatctccgttccttttctgctggaggatttctgttcagaaatgatattcccgccctgaagaatgagatgggttcccgctccctcgccgatgctcgttttgatttccagatgagaaacagacgcgatacttggcaaagcttctccgcggaaaccgagtgttctcacccggaacaggtcgttttcatctttgattttgctggtcgcgtggcggcggaaagcccgcttgcaatcatcggtttccatcccttcgccgttatcgagcacccgaatcgacgaaagccccgcttcctctatgtcgatctcaatgactgtgctgtttgcgtcaatggcgttttccaccaattctttaacgactgaggcaggccgttcgaccacctcgccggccgctattttattcgaaagttcatctgacagctggatgacttttgccaagtccgtcacctctttctattttaattttttttgcagcttgtacatttcattcatcgcctcaagcggcgtcatatcgagaatattgattgacttaaaagcttcaagcacttgtttttctttattagaaaccgccggtgccttctgttctttttcaccgtcagcaaaaaaggacagctgtgccggttcttctttgacggcgggctttttctcaggtgccgccggaagctccggtttatctcccgtctgctcaagctgtttcaaaatctcctgcgcgcggctgatcagatcgtccgggagctccgcaagctgggcgacatgaatgccgtaacttttatctgcggctccttctttgatttgatggagaaacacgaccgttccgttatattcctctgcgcgcacatgaacgtttttcagctgaggaagcttatcttcaagcaccgtcagctcatgataatgcgtgctgaacagtgttttagcgccgatatgatcatgaacatattcaataatcgcctgtgccagcgccattccgtcgtaagttgatgtcccgcggccgatttcatcaaacaggatcaggctgtcttttgtggcgttcacaatcgcgtttttcgcttccagcatttccaccataaaggtgctttgtccggaaatcaaatcatccgctgccccgattctcgtgaagatttgatcaaaaatcggcagaaccgcttcttttgcgggcacaaaacagccgatttgggccatgatcgatagaagtgcgatctgtctcatgtacgtgcttttacctgacatattcggacccgtaatcaggagcatttcccgcgaatcgcccatcaggcagttgttcggcacgtattcttgactgtccatcaccttttcaacgacggggtgtctcccttcaatgacttttacttcattatcagaaaagacgggctttgtgtaatgcctgttttcactgatcgtagcaaagcattgcagcgcatccagctcactcatttgtttggcaagacgctgcagacgcggaataaattgtttcaccttttcacgcagaccggcaaaaagctcatattccagctcgcagatgttgttttccgcttctaaaataagcgcttctttttccttcaattccggcgtaatgtaccgttcggcgtttgtgagggtctgcttccgctcataccgcccgtcctcaagcagatgaaggtttgcttttgtgacttcaatataatagccgaacactttattgaaaccgacctttaatgaacggatgcccgtataagcacgttcctgctgctccagtctggcaatccagtctttaccgtttttgctggcgtcacggtactcatcgagcttctgatgatagccgtctttaattaagttgccttcttttaacgataacggcgggttttcatgaagggcttcttctaacaggtcaagcaaatctccgcacggatcaatcaagccggcgcgttcttttgcttttttatggttaagagatcctacaagctctttaatgctcggcacttgttttaaagattctttcagctggattaaatctcttgcgttgacgtttccgaatgcgacccggcccgccagacgttctaaatcgtatacttccttcaggcgctcgcgcagatcttcgcgctcaaacagatgattgatcagcgtctcgaccatttcctggcgttcttcgatttgggatgccctgatcagcgggcggtcaatccattgtttgagaagccggccgcccattgctgttttcgtctcgtctaaaagccaaagcaatgacccttttttgcttttcgaacggatcgtttccgtcagctcaagattccgttttgaatacaggtcaattttcatcgcttcttccaattcatatacttgaaccggctgcagatgatccaggctccgtttttgcgttttctgcaaatacgtatataaacgcataaacgtctctgtcagctcttcgcccggcaagtgctttgcgatttcaatgcgttctgttatttccccgtcttcgatggaaatcgttgcgccgcaccgttctttcagctgagcagccgtatgttcgttaaacttgcttgatacgacaatttcctttgcgccgactgagtaaatttctgacatgacatcttcaatccgctcaataaatacggccaggttttctccggtcgttaagtctgataaagcgagaccgtatccgttacgaaattcggaaacggaagcgataaagttgttttccgactcatggatgccttttccatccatcacggttcccggggtgatcagctggacgacttctctttttacaacgcctttagccgccttcggatcttccgtctgctcacagatcgccactttatagccctttttaatcagctgttcaatataagccgccgcggaatgatacggcacgccgcacatcggaattttatcagccgaacctccgtctctgcttgtcagtgtaatttcaagctcttgcgacgctttttttgcatcttcaaaaaacatttcataaaagtcaccaagccgaaaaaataaaaaggcatcttggtgctctgcctttatcttcaagtattgctgtatcataggcgtgtaactagccatcatttaatccctcactatgtatcttctcttaaccgaatcccattataacataaacaaaagagtgatatctttatatataaaaaagagactcggggtgttaaactcccctagcctcaacttattcttcaggatctccgactaaaaattcagggttaatgtcctctaattcttcgtcaagatcgtcttcccaatcatcatcatcgtcttcttcccagtcaggattgacttcgacgacgactttcgtttcaccgaccacttctgccaaaaattccctctctgcctgaaccacgattttatttccgttaggagaaatggtgacttcaagacaattcggctgctgcagcactttggcaatgacttcgtgttcgtcatctaagtaatttgtatctctgtatctgagtttaatcacatcgacatactttactctctcggttacaacttccgtttttgtattatcggcgtaagagtaccagacgtttatatcataatacccttcaatttctacagtcttcccgatcttttcggcatcgtacttgtggttgataatccagccgcccagtatacttgacggtttttctccaggcgagatcgtgttggtgcattgggtgaattttcttcctttcgcaactaccgctttcgtaataatttccctgtattcagacattccggcaggcctccttgttcttcttcgtgttatcttatgctgggcatttgtctcatgtgcatttttataataaaaatataaaaatacaaagtttctgtttcattgtatgcagccctgcccagaaactttacttttaagtatgataaaactttccagtaaaaataggacaaaacgttgagacaatgaaaatttagtacatattacaattagttctcaaacagaaaaaaacacgggccgatgaaggccccgtgtttaaatagaacagctgttattcgaatgttttacttttgaaccggtttctcccgtcagcaggttgcctccggtagatgtaataatttcgtttgtcacctgatttgagatcgtatgtgcgacaagctgaagaaggtcattgacctcaatctgggaatctctgaattcctgaatgatcggaatcccttcaagctcttcctgcagggcgtcaattttactttccacttgtttcagcgcttcaagcttttcgtagtgcttcaggttaacggcttgcttttgcagggttttaatctgattaataatcgcagagactttttcattttcgttaatctgcgcctcggcgcgtttgaaaaaatcaacttcttctgtttcagaaatcattttcgcaaggttcctagcctgctgtacaatgtctttctttgagtaaagcgtcattattatttcacctcgattgcttctcctgccatcacaccgtcaagcgaccatgttttcgcctgttcgattttgacgcgtacaatcttgccgatggcgtctttcggccctttgaagttgacgagcttgcttttttccgtatagccggcaagaatgtcagggttatttttgctttctccctcaactaatacttcgacagtcctgccttcatattccttcatttttttggctgaaatttctttcaccaaatcattaaggcgctgaagacgttctttcttgaccctcatcggaacattgtctttcatcttcgctgccggcgtgccttcacgaggagagtaaataaacgtatatgcgctgtcaaattccacttcgcgatataacgaaagcgtttcttcaaattgttcatccgtttcattcggaaaaccgacaataatatcggtcgtcagtgaagcgttcggcatcgccgctttaatttttccgacaagctccagatagcgttctctgtcatatttacgggccatcatttttaacatcgctgagcttcctgattgaaccggaagatggatatggtctaaaaggttgccgcctttggcgagcacttcgatcagatgatcatcaaagtcacgcggatgactcgtcgtgaaccggattctcggaatatcaattttacgcagttcgtccattaaatcaccgagaccgtacgtcatatcctcaaaatcttttccgtacgcattcacgttttgaccgagcagcgtgatttctttatagccttcgcttgcaagtcttctgacttcctggataatttcctcaggacggcggcttcgttcttttccgcgggtatacggtacgatgcagtatgtgcagaacttgtcgcagccgtacataatgttgacccagcctttaatttttccgttgcggactttcggaaggttctcaatgacatccccttctttcgaccacacttcaatgaccatctcttttgataaatatgcctctgataacagttccggcagacggtgaatgttgtgcgtgccgaaaatcatatcgacaaacgggtgcttcttaaggatgcggtttacgactgattcttcctgtgacatgcagccgcagacgccgagaatcaagtccgggttattttttttgagcgcctttaaatggccgagctctccgaacactttgttttcagcgttttcccggatggcgcaagtgtttaataaaataacgttcgcgtcatcaaccgaatttgtcgcttcataaccgagcgccataaaaatacccgccatgacttccgtatcatgctcgttcatttggcatccgtacgtgcggatataaaatttcctgccttcaccaaggcctttaaattcttcagagattttaaaatcgttatgatattgaacggattctttgccccgttttttcgcatcttttaaagaaggcggaatatatacggcttcaaaatacttgctgtaatccttttcggattttttgtccgccggattcacttgtccgctttcctgcttttgcttttcattcatgttcgaatgtctcctttcaaccgaaacttccaccctcaagtatactggttaaaagcgtttggcacaaccgccaacctattattgtacaccttattgagaataagaatcaataagaaataaaaaagagggaatcatttcccccttacacaagctgaagctcttttgcggctgaacggattacttccagggcccggtcaagctcctcttttgtatgctccgccgtaataatggtgcggattctcgcttttccttgggcgaccgtcggatacacgatgctttgtgcaaacacgccgcgggtcaataaaaggtctgataatgcctgggctttttcttcctcccctattaatatcggcacgatcggtgtttcgctttttgtgagggtcagccccatttgaaccagtttgtctttgaaatacgccgtgttctcccatagcttttccatatgctcaggctcttccagcaggacgtcaatggcttctatgcatgcggccgttactgcaggcggatgagaagtgctgaataagaaaggacgccctttatggcgcaggtaatcgatcagaacctgcgaccctgcggcgtaaccgccaagcactccgatggctttgcttaatgtgcccacctgtatgtggactcttccctcaagcccgaagtgattaaccgtcccccttccgttttttccgagtacgccggaagcatgcgcatcgtcgaccatcacaaaggcatcgtacgcctcggcaagtttgacgatgtcaggcaaaggagcgatgttgccgtccattgagaatacgccgtcggtgacgatcaggcgcatgcggtaattcattgattttttcagcaccctttccaaatcgtccatatcaacatggcggtacacctttttatctgcttttgtcagcctgatcccgtcaataatggaagcatggttcagttcgtcagagatcacgatatcttcttttgtaagaatgcttgataagacgccctgattcgttgtgaaccccgattgaaaaacaagtgccgcttctgtttttttaaaggttgccaattttttctccagctcattgtgcattgtgaatgttccggcgattgtacggacggaccccgtacccgctccgaattcttccgcggcgcgtttggccgcttcgacaagtctcggatgcgacgtcaaaccgagataattgttcgatgaaagctgtatcacgttttcccctttgacttccaccgacggaccctgcttcgtttcaatttgtttcatttgctgccacgttttattttctttcattttatcaagctctgcttttagaaattcaaattctttcattatagaaccctccccttatggaatcaaaatgactttgccgcactgtccctttctcatcaggtcaaaccctttttcaaagtcttcaagcggaaactgatgcgtgatcaccggcgtcagatcaacaaggccggattcaagcaggtgcgatacctgccgccatgtttcaaacatttttctgcctgtgatgccttggacggtaagtcctttaaacaccacgtcatttgtcaggtcaaccgtcaccggacgttccggcagactcagcatgtggaacctccccccgttggccgccatctttaatccttgtgttatggctgccgggtggcctgacatttcgcagacaaggtcgatcccttctccgcctgttaaggtgtcgatcacctcaagcggatcttcctcatcagctgaaatggtgatcgcagctcccaatttcttcgcaagagccagcctgtaatcatttttatcaatggccgcaatacgggatgcaccggccgctttagccaccgccaccgccatcagcccgatcggtccgcagccgataattgcagcggaaccgcccgcaagcccgctgctttccagcaccgtatgcaccgcgttgccaagcggctcttgaacagaggcgacggcggggtccatatcagcggggtttttccaaacatttcgggccggcactttgacatattcagcgaaggagccggctgtatctacgccgaggatctttgtatgggtgcacacatgatgttttcctgttaaacacgggacacaagtaccgcagacgaagtgggtttcagccgaaacgtagtcacctattttgacatttgtgacgtgcttgcccgtttccgctacgataccgctgaattcatgtccgaatacttgaggtgttttgattcgtttctgcgcccattgatcccaattataaatatgcacatctgtaccgcatatagatgcggcctgtactttaatgagaacttcattctcattaatggaaggtatgggaatttctttcagttttgctccgaaagcgttttcatttttaacgatagctttcatctttcctcccaacatgtacactcctcctcgaaaaaacactgtaataactggattgtaacatgagataaaaaggaggtaaacaccagtgtccactcgaggaaaacaactgcttccgtccggaaaaatgggcgggattttttttgaatattatatgaataaagccatttatcatctcttcgtactatcaatataatattgtgagaaaatatgacagcaataaaaacaacctgctcgccttacgcaagcaggttgagaatgtacatgtttttgtttttaacggggttcgacgattaacttaatcgccgttctttcttctccgtcaatctgtatatctgtaaaagccggaatacaaatcaaatctacgccgcttggcgcgacaaagcctctggcaatcgcaaccgctttaacagcctggtttaaggcacccgccccaattgcttgaatttcggcggctccgcgttccctcaatacgccggcaagcgcgcctgctactgaatttggacttgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttctactatattcactaagaagttgctatattcctgcttttccttttaatatttttataaaataaacacatgatcacctattcaaagaacatatggtcatcattgattaatatccgttcgatatttacggcctttttcgtttgatcgtcgatgtcaatgagcactccgctcagcgtagttttaccttccgccaccgtaaaccggacgggaagattggttttaaaccgcttgatgaccgtttctctgtccataccgagaattccgtcgtacggacccgtcatgcctacatcagtaatatatgccgttcctttcggcaaaatgcggttatctgccgtttgcacgtgtgtatgggtgcctaccacggcagaggctcttccgtctgtataccagccgatcgcaattttttcgcttgtcgcttccgcgtgaaaatcaataaaaatgtacggtgtgcgctttttcgcttcttctattaattcatccgctttagcaaacggatcatcaagcggcggaagaaacgtccgcccctgtaaattaatgacggcaagctcttttccgttcgatttaatataagtaatgcctttgcccggcgtaccttccgggaaattcgccggccggacaagatgcggcacatcatcaataaagtcgaagatctctcttttatcccacgtatggtttcccattgtaatggcgtcggctcccgcttccatcaggctgtggtagatcttttccgtcagtccttttccgtgtgctgcattttctccgttaataattgtaaaatgcggtttatgtttcgctttcagtttcgggacatattcttttaccatgtcgcggcccggggaaccgacaacatctccgataaataaaattctcatacattccattccttccttttcagggactcaaaaaaataaagtgatgcgctaagcatcactttattttgcatactctacggctcgagtttctctgatcacggtcactttaatgtgtcccggataatcaagctcgtcctcaattcgtttacggatatcacgcgccaaacgatgggcttctaaatcattaatggagtccggcttcaccatgatgcgaacttcacggccggcctgaatcgcaaatgatttttcaacaccttcgtaagactcggagatttcttcaagcttttcaagtctgcggatatagttttcgagcgtttcacttctcgcgcccggtcttgcggctgacagtgcatcagcggcagcaaccagaacggcgataatggaagtcggctcttcgtctccgtggtgtgacgcaatactgttaatgacgactggatgctctttatatttggtcgcaagctccactccgatttccacgtggcttccttccacttcatggtcaattgcttttccgatgtcatgcagaagaccggcccgcttggcaagctttgcatcttctccaagctcggaagccattaaaccggctaaaaacgcaacttccatagaatgtttcagtacgttctgcccgtagcttgtacggaatttcaaccggccgaggatcttgatcagatccgggtgaagtccgtgaacgccgacttcaaacgtcgtctgctcacccatttcccggatatagtcatcaacctcacggcgggatttttcaaccatttcttcaattcgcgccggatgaatacggccatcctgaacgagtttatcaagagcgattcttgccgtctcccgtctgatcggatcaaatccggaaagaatgactgcttcaggtgtgtcatcaataatcaggtcaatacctgtaagcgtttcaagcgtacgaatattacgcccttcacggccgatgatacgtcctttcatctcatcattcggaagattgacgaccgataccgtcgtttcggcaacatgatctgctgcacagcgctgcaaagcaagcgacagaatgtttttcgcctttttatctgcctcttctttcgcacggttttcggtttcttttgtcatgatggcgatgtcatgtgaaagctcattttcaacccggtcaagaatgatttgtttcgcttcatcccgtgtcaggctcgaaatgcgttcgagttctgactgctgcatacgaatcatctcatccactttgctttccatctcttcaatatgttgttgtcgttcattcagagaatgatctttcttctccaacatcgcttcccgtttatcaattccttcatgtttacggtcaagattttcttctttttgaagtaaacggttttcttgtttttgaagctcatttcgtctttcacgaacttcctgttcagcatctattcgaagtgtatggatttcgtcctttgcttcaagcagagcttcttttttcagtgcttcagcatcacgctttgcatcttcaaggatttgctcggcagcaccgcgtgcgcccgcaatctttgcttcggcaatggttttacgaacatagtagccaacaactaaaccgagcagagtcagcaaaatggagatgagaaccgtcattggggtcatactttcacctcctcttgctatgaacttggtttttgcttaaataagtgccggcatgtacattgtctgattttctcaacatacagaaccttcacagggaatgagtctctcatgcccttgtcaagtttaaatggtttaacaatcatgttaaaaaaacaaatgttacaacttcattgtaattgtgtcggaaatacttgtcaagcttgccagcttaacgattcgccttcagctcggatcgccgcccatgtatatatcataccataccttcatccgcttttcgtgaatgacggctctgtcagtccgcctggttaagcaattggtaaattctattgtttacctgtcctaatttggcgttattctgaatgtttgacagtaatatgacatatttgcttgccgaatggctgaaactgtttaaaatgttgtaaccgggcataacaccgtgattggaatagctgcccggatcaatgtaaaaccccatcccgtaagcggcactgcttcctgctgtaaacatttttgtgaagctttcttttgaaaggagcgtgccgtttacgatcgctttatcaaatttataaagatcttcagcgctcatatacatgtcgcccgccccgtaaagctgcgataagtccaaaaggtgcggcgttacaagactgccgctctcatcgactttgtagccgacggcaggatatttggcttcagcaaatgttttgtaaaatccggcatgcttcattccggccggtttgaacacgtgttcttttatatattgttcataagactccccgctgacctgagatacgatataagcaagcactgaatagttggaatccctgtaatcccaaaccccgggctgccttttaattccgcggtattctatatccttgattaaatcaattggagaaatcggtccccgaccctcaatatgcccgtttatgccggacgtatgattgagcaggtttttcaatgtgatgcgcgtgccgttaggaaaattcggcaagtatgtactgacggggtcactcgtctgcagcagccctttttcttcaagctgcaggacagccgtcgcgattaacgctttttgtgaagaaccgatataatatgatgtctccggattgtttttaattttttgttttcggtctgcatagccaaagccttttttcagcacaacttttccatcttttacgatcattgctgtgccgctgaacccgatctgttgcaagtaattgctgatctgtttattgtgatcgattgatttaggtgttttctctttttgcgtcttttcttttttctgttgagtctggtcttttgaagtatcagattgagcggcgggagcgtttttaacggattccttctcccgatgatgcgctgtgacggtccagatcataataaaaacagtgacaagcagcagaaaaagaaacagccctcccgttttcatcagcttcttctttctttttttatttattcttgtgcggcgggggctcgtcatcttttttcctcctcagatataatttcaactttcgccatgatgttagacgagtgaagggtgaaaaaagttgtaacattccagataaaattttccgaaacagccagtgtttttttgaaacatacaaaaaaaaagagcggaaattgcttattccgctcttttgatcgtgtttttattcttctaattccatctcttcctgaacttcttccgctttgtccgttacaccgttattgtctaaaccgtaatattcacggatttgttcctgaatcatcagcatgatgtctttattttcttttaagaactgcttggcgttttcacggccctgaccgaggcgttcttcttcataagaataccacgaaccgcttttttgcacgatatccagttcagttccaaggtcgatgatttccccttctttggagattccttcaccgtacataatgtccacttcagccgtacggaacggaggagcgactttgttttttacgactttaattctcgttttattccccatcacgtcgttgccctgctttaattgctcggcacggcgcacttcaagacgcacggaagaatagaatttcagcgcgcggccgcccggtgtcgtctccggatttccgaacataacgccgactttttcacgaatctggttaataaagattgcgattgttttagatttattgatagcgccggaaagcttacggagcgcctgagacataagacgcgcctgtaaaccgacgtgtgaatcacccatgtcaccttcaatttcagcttttggaacaagcgccgcaacagagtcaacgactacgatatcaacagctccgcttcgcaccagcgcttcagcaatctcaagcgcctgctctcccgtatccggctgagaaagcagaagctcttcgatattgacaccgagcttttgcgcgtaaacaggatcaagagcatgctcagcatcaataaatgcggcctgtccgcctttttcctgaacctcagcgattgcgtgaagcgctacagtcgttttacctgaactttcaggtccgtatacttcaataatccgtccgcgcgggtatccgcctattccgagagcggtatcaagtgcaagggagccgcttggcaccgttgaaattcttgtatccgttttttctccgagcttcatgatggaacctttgccgaattgtttttctatttgcttaagagccatatctaaggctgcctgacgatcactcatttattttttcctcctttatcttgccactacatatactataccttgtttattggcatttgccaagaaaaaagcgaacgcatattcggattttttccgcgttcgcttttctgcaaaagagcataatttcccttataaaacttaaaaatcagagaaaaaagctctttaaaactttatttttgatccagcatttttaaaatgagatggcagccgtatttagcggcgcgctttctgattccggttcttgagccggcaaagtgaaattcgtgcacctcttcttttccttccgctgaaatgccgataaagacgcggcccggcgcatgcccttcctgcgggtcgggacccgcgaccccggtaaagctgatgccgatatcgcttccggtcagctttctcacaccggctgcaagctctttcgcacactctttgctgaccgctccgctttctgcgagcgtctcagctttcacgccgagcacatgctgtttcacgctgtcggaatagcagacaacgcctcctgcaaatagttgagacgcaccgcttaaatcagtcacccactctgaaaacaggccgcctgtaaagctttcggcagaagaaatcgtgattttgttttgtctgcatgcttttgaaagctccttcaccagggacgtatcatcatatccgtagaaaaattcaccgacacgttctaaaatggcggcttccgtttcttttaaaagccgttctgtttctttttcgtcagcatgtttcgccgttaaacgcagcgtgacctcgccgtcagcagcaagcggcgcaatcgtcggattcgtctgcgcgtcaatgatatcttctaaatcagcttcaagctgggattcaccgattccgaaaaaccgcagcacggttgaaacgattttctcattagaaccaagctttttaagaagcagcggtttcgcttcattttcaaacatcggacgcagctcgctcggcggcccgggaagcagcatataaagccttgagccgtgctctgcaagcattcccggcgccatgccgaaatgattcgccaaaacgtccgagccctcaatgacgagcgcctgtttgcggttattcggcgacatggtccgttttgttttcgcgaaatattcttcgatcgaccggaacgcttcgtcattcagaacgagcgggcgccccagtgtgtttgcaatggtttctttcgtcaaatcgtccttggtcggtccgaggccgcctgaaaaaataatcaggtctgagcgctcttcggcaatgcggatgacttgcttaagccgctccggattgtcaccgacagcggtatggtaaaacacgtttacaccgatttccgccagctctttactgataaactgcgcgttcgtattggcgatctggccgagcagaagctccgagccgaccgcaatgatttctgctttttttgctatttccatctttaagtccttcttccttagttagatgtttttaacgcatcccagttcttcgcaaaataatcccagccggaaatgactgtgaagagcacggccacccataaagcgatatcgccgaacgggaaagaaacgagctcaaacggaagattatgcagcaaaagcgcggcaacagcgatgatctgggcccatgttttaattttccccagcatattggcggctacaacttcccccgttcccgccagcacaagtcttaatcccgttacggcaaattcgcggctgatgatgatgatgaccatccacgccggcgcaaggtcaaattgcacaagcgtaattaatgccgcggacaccagcagtttgtcagccagcggatctaaaaatttcccgaagtttgtcacgaggttcagttttctggcgtagtagccatccacccagtcagtcgttgatgcgataatgaacaaaacagctcccgtaagatgcgcgaccggaatcgattcatcccctatatgaacgctgccccaatgaaaaggaacaagcatgataatcataaatacaggaattaaagcgattcttgccagtgtgattttattcggtaagttaaacataaagcccctccaataatatgtactcggacgtgaagaaaaagtcatcttaatcgttcagatgacttttcccccttttattttttcatcttgattgtgatggtctgcgccatcacatcatgcggattgagttcataggacagaacctctccgttgattttaattttcaggttaggggcatagcccgtgcggatttcaatctgcttttgatccgtgacgtcttttttaaaggtttcgcctttttgcagcgttccttcttttaaagaaccgccgctgtcatcacggacgcggatccatgcgctgtcagaagcaatcagttcaagcttatacttatctgccccggagacgttgtatgaagaagccgagccttccgttccggccgctttgatctccgtcttttcactgcttttttctttctttttctgctctgacgcttttgtgtcttttttgtcttttttgctgtcagattgcgcttcgtcgtttgtattgccgtcgtttttcagcgcagaatccttaggaatctcatacttgctctcactttgggtgacggtcttatctccgtctgtctgcccggatttgctcattccgaactgaataatcgcataaatgatcgcgatgacgataatgacaccgatgacgacaaggacggtcggaagccattccgccgcctttgaagcggacttaggaagctccctttgcatggcgagaccggagattttttccgacacatcgtcatggtacgtgttagggatgtcttttttatattcttcaaataactgatctgaatcaagcccgacagcttcagcgtactgcttgataaacgcccgcacataaaaattgccgggaatgacgtcataattgccttcttccagagcggttaagtatcttttctgaattttcgtcgccgcctggagttcatccaatgacatccctttttcctctctggcttctttaagccggattgctaattctgtcacaacaaacaccttccaatattaaaaatcaaagcttgaaaaaccggtctggtcaaacatttgcggttcttctgcatgttcatatgtaatgacttcgtcaggatcatttctgagttcgataatataatcgaaatcatcgagcgtatactccgaattttgaacaaaaatatcggggtgctccacgacctttgtcgccggaagccgcataatttcactgacgagctgaagatggcgctcagatccccgtcttgtcgaaacgatgccgtcgaggataaacacgttttccgtgctgtattcatcggcaaccagctggctccggatcgtttgttttagcagcgttgatgatacgaaaagccatcttttgctggcacaaacacttgacgcaacgatggactccgtttttccgaccctcggcattccgcggattccgatcagtttgtgcccttcttttttaaacagctcggccataaagtcaaccagaagaccgagctcgtccctttcaaaacggaaggtttttttgtcatcggcatcacgctgaatgtatcttccgtggcggactgcaagacggtcgcgaagcctcggttctctcagcttcgttactttaatggtctccattgtttttaaaattgattccaatcgtttaatttgatctatatgccggcatctgagcagcattccccttctggaaaggtcgacaccgttaattgtgacaatattaattgacagcatcccgagaagagatgaaatatccccgagcaggccggggcggttcacttgaatttcatattcaaaataccattcgagctttgccaaatgatataccccctccattgtggcaaatttttaccttcctttatcataaaacatttttctctaattagaaagaagaatgttgctctatagaggaaaacataaaaaaagagaggagaaatcccccctcttaatgagtgctgttattttcaacaagcttcaccatcatatttgcgatggcgcgctgttcatcttcagaagcaacgctccaaagatcagcaagcactttttcctgatggtttttcgagtcgacttcgttcgcaaggtaaccgccgatttctgtcgcgaggtcagtgatcgtttcatcactcatccctttttcctgcgcatagttcaatctgtcgccaaggaaattcttccaattatcccagttttctaatactgacatgttgggttcctccatttcatctgttgttacaaaattattttgtccgtgcagatgcaaactatacacacatttttttcagcagtgccagccgccgtttacggataatatatgccccgtaatataggaagccttgtccgataataaaaaggccgccgcttcggcgatttcctccggctttgccagccggcccgcgggaatttcctctgccaacgcttctttttcatcagacgtgaattgatcaagcatatttgtatcaacggcacccggggagaccgcattcacgcggacgccgctcggagcgagctctttggcaagcgctttgacgaacgaatgctgcgctcctttgaccatgctgtataatacctcgcacgatgcacctgtttctccccagacggaaccgatcgcgacaatgcccccgcattttttccggatcatgccgggcaccagattacgcgccaaaagaaacggactcgtcacatgcagctgcaccatctcccgcgccgtgtcatccgtaacgtccgtaatcaggccgaaatgacttttgccgctgtttaatatcagagcgtccacaggctgcttaacggaacggctgagtgtctccgcgccatccggtgaggacagatcagcctggatagcggaggcttttacgccgaatgatgcgctcagcctttccgcaagcctgtttgcggcttccttattagaatgataatgcaaaaggacgtcatatccgttttttgcgaggacttcacttatactttgtccgattccgccgcttgctccggttacgagcgctgtctgtttcatcaatcaatactccttctttccccagaaaaacatccctcagggcgtgagggatgttttgttatgattttggcacgactttgcagactgtcagcctgtcttctgatatttcttctttaatgacccgctttacgtcttccagggtgatctgctccagtacggttacgacatcaaacagactcatatctaaaaaggcgtagcgtgtgaattggttggcgatgtattcaggcgaattgagcgcttttaaaaatgacccgatcttcttttttctcgcaaggtcaagtttttccgcagtcacggctgattctgcatcaagaagcatctgttttaattcgtcagcgagcttatccggctccggtgtatctcctccgacagaggcaaagccgaatccgtattcagccgtgtaatcaaagctgaaggtttcatcaatgtagcctttatcgtacaagttgccgtaatgcggtgagctttttccgaagagacattcaagcatgaggttcatgctgagctcgtgcttcaacagctcccgccccgttttataagggtctttcgcctttaaaccgacaagacattttgagccttgcacgttcatttttaattcctgctcccggcggaaaaccgcttcctgctcctgaacctctttacgtttgatttcaggctggtctgtaaacggctttttctcctggtttttccgcacctggctgatgatcgcttcaggatctgcggggccgacgataaagagcagcatattgctcggatgataaaacgtttcgtagcactcatacagcagatctttcgtaatatgagagatgctctccaccgttccggcaatgtcaattttcacaggatggtctttatacatattttcgataaggccgaaaaacagccgccaatccggattatcatcatacatattgatttcctggccgatgatgcctttttctttttcaactgatttttccgtgaaatacggatcctgaacaaaatccacgagtgtttccaggtttttctctacattagaagtgctggagaacagataagcggttcgtgtaaatgatgtaaaggcatttgccgacgccccctgcttactgaagtcctgaaacacgtcgccgtccgctttttcaaacagtttatgttccagaaaatgcgcgattccgtcaggcacgtgtaccatttcttccttatttaaaggaacgaattgattgtcaatggaaccgtactttgtcgtaaacacggcgtatgttttattaaaaccctgtttcggcagcacatagacatcaaggccgtttgccattttttcatgatacagcgtttcctgaagctgttcgaaatttatcggtttagtcaagatgctccccccgtcccttttaagaaataagtcgtatccagcttaatgttctttccgacattgataatgtcctcttttgtcactttctcgatattgtcgaggaaagtttcgatcggtatctccacttgggctgaagcctgctgatacagaaattccgctaagccgtatgccgtatcaatcgtttctaacacttggtttttaataacggctttcgtttgggcgatatcgtcctctgaaaagtcaccgttttgcatagcctgaaattgttcttcgataatggtgacggcctgcttataatttttcacctcaatgcccgacatgaccatcaaaagccctttgaagctttccacccttgaggctgcataataggcgaggcttgctttttcacggacatttataaacagctttgaatgagagaaacccccgaacagcccgttaaacacctgcaatgccggataatccggatctgtatatgtcgtattggtccggaatccgatattcagcttgccctgcttgacgtcctcttcatcaatgacttccttcggatcgggctgttcattcgtcttgcttctttcaaaaggctgcagctcccgttcttccgttttaaaatacgtatcaacggccgttttcacctgatctgaatcaacatcgccgatgacgtacaggtccagctgatcttcgcgtatggctttttgataggcttcatacaactcttgcggtgtaatgtgttcaacatcatcgaactcgccgttgacgtgaagggcatacggttcgcttttgcacatttcctgaacgagacgcagattagaatatctcatcttatcatcatatacggcttgaatccgctgtttcagcgtccgtttttcctgcgtgacataaaggggcaggaaggcgccgttttccaaagcgggcgaaaagacaagctctgataaaagctgaaggcctttttccaataacggtgtgcggtccttcagatacttttcgttaggaatctcaagtctgaacgtaatgacatgacgttctcccttttttgtcagatcagctgaaacggatgtgccgtacagctcatcaaaataagaacgcagatcagcggttttcgggcggctttctgttccgcgcagaagcacatgcggaaatagcgccctttttgttacgagctctttcgttaaaggagccagcattttaaacgtcagcgaaacggttttaaatttctcagtctttacgatgtgggcggtgatcccgccgtgctttgacttcatttcatttacgtaagtcatgtgaaacctccttcgttcattctttaatagtatgtattatggccaaatttcaggattcgcaaaaaagagtgcgcagatgtaattatatcaactggaggatttataaggaaacaaaaaacctctgcccgaaaacaggcagaggcattgaacgttattttttcaaattgaaaggccaccagttggctcttccgaatattttcaccatgaccggcacaaaaaacggaaggacgacaattgcgtacatgagaaggcctgttaataccacggttgcaatctgtaataaggaaagaacgcctgacggcagcatggccgcaaaggttcccgctaaaataatcgccgcagaaatgatgacggaacccatatttttcatactgctgatcattgcgggttccgttccttcttttttcagctcattaaagcggtccattaaaaagatggaataatccacaccaagagccatcaaaatgacaaagccgaagaacggcacggcccagtttacgcccggatacccgaagaagtgtgtaaagatgtattccgtcacgccgatggatgcgaaatacgtcagtacgagcgacgccactaaataaacaggcataataagagagcgcagcattatgatgagaatcagaaaaattcccgccagcataaacattgccgtccgtttgaagtctgaatccgatacttctttcagatcggcattcatgctggagactcccgaaacgccgaaagaggcattcttcagatccgtgttcggaatggctctttttacgctcgctttgatcgcttgaatatcttgaatggccgtatttgagtaaggattgttatcaagaacgacggtcaattctgtcgtttttctgtcatctgacatgtacgtattaaacacgcttgtgaaatcactgtttgtcaacgcgtctttcggcacaaaccagcctgtcatttctttatctgaggccttgtgaagctcacccaggtaatcattcgcccccatcatgccgcttgatactttcttaagcccttttacactatcgttaaggcctgaagaaagatcgctgagccgggaagaaaaatcaccgagaccgctcttcatttttttctggccctccgcgagctgtcctgccgccgattcaaggcgcggcatttgtcctgcaagagccccctgtccgtctgacacttgctgcagaccgttttcaatactggtcagaccggtgatcattgcgttaatttgagtgtcgatctttttttgagcggctgccagccgggcaaattgtttttccgcttgctgcagatgatccttttgactgtcgacctgtttagaaaacgcttctgcatccgcgtttgccttggaaacggctgactgtacacccgtaaaggccgatttgatttctttgtaagagggatcggttttgactgacggtattgacgcttccaattttgcaaacggcagccgggcaagctgcttgttcaaatcggcaagctgtctgctggcttcatctttcatcggcaggacggtttttaccaattttaaagcgttttgcgtttctgaagcgagaccgctgttttgtttgagctgtgaagtcagcatttgtttttgctcttcaatctgctttctcatctgggcgacgccggctttattctcattcacgccagcctgcagtttattcaggttttcgcctatatcagaaagcccggatttcagagacaatgttccgttaataagctgattgacgcttttccccgactcttcgatctgcggctgtgaatcagctaacgactttgcggcatgccctaatccgtccgtgattttttcaagtcctgtattgcctttatcaagcccttcttgaagctgctttgcctgatttgtgacaaataattgattcaatccgtttccggcagggcgcgtggcgcttctgaccgtttttacaccctctgttttttcaagttctctgctgattttttcgatatcaatcaggtgtttttcggtatttagaggctcatcatttttgatgacgactgtggccggaagaagctcccccgggccgaatgcgtctgaaatcgtattaaacgcgcggacggattcatatttatccccgatttcgtcaaggctgttgtaagatagcgatcctttgtaaagaaggataggcgggacggtgaataccgcaacgattgcaagactgatgagcggccttttaaatgaaaaccgccctgccgtttcccaagctttgctttgaggatgggaaatatcacccttaacgggccaaaacagtctttttcctaaaaaagccataaaaaacggcacgatcgtcatgagcgcaagcagcagcaccgcgacaccgaccgcaacggcggctgccgactgatacagcttaaatgtcgcaaacccaatgcaggcaaatccgatcagcaccgcaccgccgctgtacaaaaccgtctttccggccgttttgtaggtgacgacgatcgcctctcttatatcagcgccatgcgacagttcttctttaaatctgctgagaagcagaatgcagtagtctgtgccgattccgaacataatcgcaaccatgaaaatctgcgtaaaagttgagagcggaaaattcagctggtcgactaaaaatgcgacaatcgactggctgactaaataagatatcaatacagataaaagcggcacaaacggagcgaccactgaccggaatacaaggatcagcacgatcaggataaaagcgaccgttatatattcagtctttttcaatccgtcctgtgagctttttaacacatcttcatcgatcagcgactggcctgtaatgccgtatgatacgccgtacggtttcagctctttatcaattttatttttgatttcgaggatatcgtttttggatgtatcaagctgcagctgaacgagcatcgtttgtctgtcttttgacagcagctgttttttgatgtcgtcatttttctccccgaagtatgaagtcaccgttttaatctgaagcgcttttttctgttcagacaaagtgctgacggcttcttccagacgatcttttttgtctgtcattaagcctttttcgtgaaatacgatgacggcagaagaagacggtgcatctgaatcagacatttcatcaagcaattcatgggcataagaagaggaatatccgtccggtacggaaatctgtcctttctcccgtgtcaattcagccatatcaggcgctgtaagcataaatatcaccgttgcggcgatccataccgcggcgatgatccagcgggctcggataatgtttttcattatgtctgctgatcctcctctgtcatcatcaatcgatataatttttcatatgtattaacgaacatctccgcctcgtcttcatcaaaatacataatatatgaacggacgagttcctcaatccgccgctccacacggtgaaatacttccgtccccttttccgtgacatttaaaagtatgctccggcggtcgctttggctgcgtgctctattgatgtagcctttttcatacaggcggttcgtcatcgatgtaatggcgcttttattgacgtggcacaccgcggccagttcaattgatttgcaatccggattgagcataatatagcggagtatgtaatattgatccaatgtcagctctttgttcactttttcagcgataatgctgtcaattttttttaagacgtgcaggtatacatcggaataacgctgaatcagctgctttactttttcttcatgcatcttttccccctccttccaatagttaaaatgtttaactattaaaaaggataacgacttgacgatatcatgtcaatcttcaaaataaaataaaaaaagacagtgcagattacaccgtctttaatgattcctttttttcttttgcttgtgatgagatatttaacagcgctaaaaatacagacacaatgccgcaaaaagcggataaaataaaaatcagccagcctgcatttgacatcagggcagcaaagatcggcggtcccgcagctactccgataaaccgcatgctgttataaaatgaggtgatggttcccgattcctcgttgtctacgccttctgtgatgacagcgtctaatgccggtaatgctattccgataccgataccgctgacacacaaaaagataaataataaataaaaactgtgattccaccataggccgataaacgacagtgtcacggcactcattccgaaaacgatgcagaacttcattttgccttggtctttcccgatttttctgcctgatatatatgaactgacggatagaaataaaagcgggattgccaaaagcgctcctttagccacaccgtcaattccgtatttcttctccagtgagtctgataaataaaaaagaaccccgaacagcaaaaacataatcacgcagccgatgataaataccgtaaagagccagcgtccgtcacgcttaaatatgcggccgacattttttacaaattcggaaatagaaggggcttctttttgtttctccggctttgccaccaaaaacaatacgagaaaaaaactgataagcgaaaaaaacggaatgaaccaaaacggcataaaccaaaaccatgcagccaagagcgacccgagaatcgggcttaatactttcccggccgtgtttgacgtctcaatgtcgccgagccccgcggtaatccgctcatcatcccctttgaataaatcaccgataaacggcatcactacaggagccgcccctgccgaaccgattccctgcagcacccgccccgccaagataatgggataaggatgcttgaacgcggtggaagctatcgcggcaagcgctccgcccgcaccggctatgagaagacaaggcagaagaaccttttttcttccgaatttatcggacaaatatccggcaatcggaatacaaataatcgccacaatcgaatagaccgttataattaacgatacttgaaaagacgatatggacagcttcttttcaatcatcggaagcacaggaatcagcatggaattcccgagtgtcatcacgagcggtacagaagccagagcaatgatattttttgttccatttttcttcttactcaacttattcacccattcactatacttggttgtttcctgttttattgtgccttgcggaaaacaaagtatgtattgaagcggcaaataaaaaaacagacacatgacgcgtctgtcttaaaaacgttttcttacaacatgaaaactgaacttatcagcccggaaataatttaatgaatacagcacaggttcatcattctgattatagtgggtttgcttcagcaataaaagcgccgtctccggctcgcactccaaaaccggtgaaatcgtatcgtgatatccgatcggttcgatatcagcaacggcatagctgatcacagacccggagtttttttccaaaagatcaaaaatagattcctgttcatgacagaaagaattcggcagaatgtgcatcggaatcgtatctaaacagtaaacgaccggagtgccgcttgccgttctcacgcgttccaaataaaaaagctcctgctcaggctcaagccggaatctagcgatatcttcatcagacggcgtaatgacctgagacgacaaaaaaatcgtacccggcaccatgttcgcctgctgaatcattttcgtcacgctgttgagctgttcaatacctgaaagaaacagcggttttgtatggacgaaagtgcccacaccgtgccttctgataatcacatgctcctcttcaaggatacgcaaagcttcacgcagagttgcccggctgacacccatagattttgaaagctcaaattcagaaggaagcttttccttttcggtgtaaattccgttttgtatatcctctttgattcgctcaatcacttttaggtacaagtgacgattgtcagcttttgtagacatgtttcccctccgtaaaccactttcataaattattgaacaattgggacaactatatcatgttttaataaaaaaataaataggaatgattttggtgatatcattttcagtgaaaactctctcctttttaagaagagagctcatcatattgttccttagataatagtacttccctcggtttgctcccttcatacggcccgacgacgccccgttcctccattgcgtcaatcagacgggcagctctcgtatatccgattctgaaccgcctttgaagcatggagactgatgccgtctgcatgccgataatcaaatcgaccgcctcgtcatagagatcatccgttacttcactgtgtgtttccgacacttcttccggaatcatctcttcttgatactgcgctttttgctgcgtaatgacatgatcgacgacatgctcaacctcttcatcggataagaatgccccttgcacacgcaccggcttatttgcgcctacaggcagaaacagcatgtctccgcgccccagaagcttttcagcgccgcccatgtctaaaattgtccgtgaatcggtctgagatgagacactgaaggcaattcttgacggaatattggctttaataacaccggtaatgacatcgactgaaggccgctgagtcgcgataatcaaatgaattcccgccgcccgcgccatctgtgaaagtctcgtaattgaatcttccacgtcggaagaagcgaccatcatcagatcggcaagctcgtcaacgatgacgacgatgtacggcagctcaggctgcttgacttcttcttcggcatttgaccgcttaatatggtcgttatagccttctatatttctcgtacccgtatgggagaacagctcatagcggcgctccatctcattgacgacctttttcaaagcctgcgaggcctttttcggatctgtcacgaccggcgcaagcagatgaggaatgccgttatacacattcagctcaaccattttcgggtcaatcatcatcatcttcacttcatgcggtttggccctcatcagaatgctcgtaataataccgttgacacagacgctttttccgcttcccgttgcccccgctacgagcaggtggggcattttgttcagttcggcaagcacggcttccccggaaatatttcgtcccaagccgatcagaagcttcgcgtccggcttgtcattgagcttggattcaagcacttcttttaacgaaaccatcgcaacttcagcattgggcacctcgatgccgattgctgatttgcccggaatcggcgcttctatccggatatccttggcggcaagcgcgagcgcgaggtcatcgctcagattcacgattttactgactttgaccccgacgtccggatacacctcatattttgtgaccgccgggccgagatgaacttgggtcactttcgcctttacaccgaagctttgaaaagtccgttcgagttttcttgcattctcgtaaatgtttttcttatcggtctgctggccggtatgtttcgggtcagccaggatgtccaatgaaggcatttgataatctttattttcaagctctgtaaacgtcatcggcggagccgcagccgtttcgtcactgtcttgaacgccgccggaaggctcatcttttgccgtttgcgccgcctcctgcattttttccggaatcagcggttcgacgcgttcttcctgacggtctgaaaagcttgaaataatcggctctgaatggatgatcggcgaaatgatttcctcatcctcttcttcgggctcaggcatttcttttttcttctgaacccgtttttgttttttgcccgatttggtttttgttttcggcgaagacatattcgttctgaccgttttcatatcctcaagaaatgcctgccattgaccgcggataaaccggccgacggggctcgtccactttttgagcgtttcctgcagtgaacgccccgttacaagaatcagtcccattaagatcagcacgatcgccatgatctgtgaacccgttgatgcaaataaaaagtgggaagctgcaaacagcaccgcgccgatcatgccgccgcccaaatcaggggaagcagcctgctgtttcatgtcaatcataaacagctcccacgtgttgccgatgacacttgccgaccgaatcgacccgtgatgagacagatttttaaagagctgcacgtgagacagcagcaaaatactggcgataatacagtacaaccctgcctttctcctcgttaaaaggcttggactcttctttttccaaaacagcgaaattccgagaaggaagagcgcaattaagcataaaataaaccactctccggcaaaaaaacggaacaagtacacaaatgtctgtcccacaacgccgagctgcaaaacagcaataatcgagattgcaacacagagcagtccgcttagttcgtattttagattgagcttactctcttgtttctttttagatttccgttttttctttgccacactcatcaccttactgcgttaaaaaatgtaaaatcatacatcatgaagaaaagcagccttttgccggctgcatttttctgtaggattcccctattatagcatattttgcccccgagaaacggactgaatgccggttagattttcagcttgattttttgtcccggagcgatgtccggattcagaaaatccatcgggttcgtacttaaaatctgtacgacttcagcttcatttcccttcatctcaaccagcagcggcacgccggcgtaatctacctgttcatgcacgctttgttctatatcctgaccgtaaacgacttcttggggcatgacggtataaaggatcattgaatcatccttccttcctcgccctttcgttcctcaatcagctgattcagcttttttatcgcctgtccgacgccgcccacggcatcaattaatccgtaatcagccgcatctttgccgactacgttcgttccgatgtccctggttaagtttccttttgaaaacatcagctctttgaatttttcttcggaaatatttgaatgatgggtcacaaagttgacgacccgctcctgcattttatccaggtattcaaacgtttgcggaacgccgataaccagacctgtaagccgaacggggtgaatggtcattgtcgctgtctccgcgataaaactatgatcacatgacacggcgatcggcacacctatggagtggcctccgccgagtacgattgagacggtcggttttgataaggatgcgagcatttccgcaatcgcaagccccgcttccacatcgcctccgacggtgtttaagatgatcagaagtccttcgattttcggattttgctcaatggcgacgatttgcggaatgacatgttcatatttggttgttttattttgcggcgggagctgtacgtgcccctcaatttggccgatgatcgtcaggcagtgaatattggtatcttgggacatttgcggcagagatgtctctcccagctgctgaattttgctcataatgctgtctttcgcatctgatttttcgggctgctgttcttcggtgttttccatacgatgatccattttatctttcaccctttccgaatgtctctttgtattatgaacaaagatgatgatttccatccggaacatgaacaaaaacaaagccggagcatcatgcgctccggctttgtaacattatacttccataatgatcggaatgatcatcggcttgcgttttgttttttcataaaggaattgattcagcgcatcacgcattgcttgtttcagcgtggaccattctacggcagatgtttccgtcgcttcagtcacgatagagcggacgagctcagtagcttgtacaattaacccctctgattctctgacatacacgaaaccgcgcgtaatgatctcagggcctgaaacaaggttcttcttctgcttatcgagtgaaatcacgacgatgagaatgccgtcttgtgacaataagcggcggtctctcagcacgatgttgccgatgtcgccgactccgaggccgtcaatcagaacgtttccgtatgtgactttatccccgattttcacattctggccgcggaattcaacgacatcacctttttcaatcaagaaaatgtcgctgcgtttcatgccgatctcttctgcgattttggaatgcgctttttgcattctgaattcaccgttaaccggaattaaatatttcggtttcagcaaattaagcatgagtttcaattcttcctgcgaaccgtgaccggacacatgcactcgtttttgggcgaaaatgacttgagcgccggcgcgggcaagcaggttgacggttttggaatatatcaattcatgccccggaatcggtgttgatgcaatgacaacggtgtctccttcttcaatgttaagctgcttgtgcgcctgcttggccattcgcgtaagagcggccagcggctcaccatggcttccggctgtaacaattgccacgtcccgcttcggatattttttcacatcctgcacaggaataaacatttcatcttcggcttcaatatagccgagcttgcgtccaagctgaagcacgttttgcagattttttccggcgattgcaagtttgcggccgttctggacggcagcctgtatcacttgctggatccggttgatattagacgcgaatacagcaatgatgacacggttttctgaattgttcatcgcatcggaaatttcaccgcttacatatgcttctgacggagtataccccgggcgctccgcattggcgctgtcagaaagcagggcgagcacgccgctgtttccgattttggcaatttcgccaatatcacatgattgatgataagcaggcgtctggtcaaatttgaagtctcccgtgcatacaatagagccaagtgatgttttgaagctgactcccactgaatccggaatactgtgaatcgttttaaagaacgatactttcgttgattcaaatgtaatgactgatttagagtgaacttcacgcaaatcagcttttcgattatgcccgtattgcttgagtttttctctcagtaatgcaagcgtaagcttcgtcccgtataccggcaccgacagcttgttcaataaataaaagacgcccccgatgttttcatcgtgcccgtgtgtcagaaagatggccttcacgcggtcagcccgttctactaagtaggaaatatccggaatgacgacatcaataccgagcatttcattttcagggtgcatcagccctgcatccactacaaatatgtctgagtcaatttcaatgacatataggttcttcccaatttctccgacgccgccaagggcgataattctgacgttttctgtatttttctttttcaaaatctgtatcctcctagtctcatacccgtccatcatcacttgttcctattataactgatatcaattttagaaaacaagaagaagcggaaggtttagggaaaaccaatatgtatacaaaacggtcaaactcacgataaaaatgagaatgaccgcgtatttcaactgtataaattttttcttacagttcgctgatgacgctgctcaggctcagacgttcatcttcattcagcgggataagaggaagacgcacagatccgacatcaaggcctttcagctgcagcgccgttttgaccggagccggattaggcgctttaaagagctccttcatgatcggcagaagcttctgatgaatcagtgccgcggttgccgtctgcccgttcgtatagtttttaatcatctgctgcatgtcagaacccacaatatggctggccactgacacgactcctcttccgccgactgcaagaataggaagcgttaacccgtcatcacctgaatagacgtaaaaatcttccggtgtttcggcaatgattttcgtaatggcatcaagatcgccgctcgcttctttaatcgcagagatattcggaatctccgcaagtctgatggccgtttccggcgcaagcgaagcgaccgttctgcccggcacgttgtaaagcatcacaggaagagacgtttcttcagctatggctttaaaatgacggtacatcccctcttgggaaggcttattataatacggcgtgacaagcataacgcaatcgacgccggcttcttcagctttttttgtcagtttaatggagtctttcgtattgttgcttcccgtacccgcaataacaggcacgcgtccgttcacttctttgactgtaaattcaaagagtgcaattttttcttccgttgaaagtgtcggggattcgccggtcgtgcctgcgacgactaaagaatccgtgccgtttttcaacaaatagtcgattaatgtagacagtttttgaaagtctacattccctttactgtcaaagggggtaatcatcgctgtagatatatttccgacattcatttttttcacctcatcatgattcaatcacatttactttgaaagttcaaacacttcatgcagcgcatttacggccgttaccatatctttttcatgaacgagcacccagatcgtcgtatggctgtcggcagattgcagaatcggaatgcctttatcagaaagtgcggagacgatttttgacgtgacacccggaacacccattattccggcgccgaccgctgacactttcgcacagctttccgtcactgtcggctcatatcctaattcagccaaaatgctgcgcgcggcttccgttttactgccggctacggtatatacgatttcactcggcgtaatgttaaagaaatctacactgattccggcatttgccattgctttaaagacttcagtctgaacgttgtattgccccattttggcgggaaccttaaattgcgtcacgtctttcacatgggcgatccccgtaatcagccgttcgaatacatcgctgccgatgttagacgaatgatgggacgtcaccaaagtgcctttgtcttttgaataagtggagcgcacgcggatcggcacctttgcctgcatggcgatttccaccgcgcgcggatgaatgactttcgcgccttgataagcaaggttgcagatttccgtatatgtgacattcggaagcggcttagcattttccacgattctcggatcggctgtcataacaccttccacgtccgtaaaaatgtcgataaactcagcatcaaccgccgcgccgagcgccgccgctgatgtatcgcttccacctctgccgatcgtcgtcgtgtcgcctttttcagtcgctccctgaaagcctgcgacaacgacggcatcatggctggcgagtgcagcgaaaagccgctctgttttcatttctataattttggcgtcagtatgctgggcattggttaaaaagccggcctgagctcctgttaaagctgcggcttttatgccgttttccttcagcatgctggaaaaaacaacggacgaaatcgtttctccgcaagacagaagcatatcctgctctctcggagaaatgtcggactggctgccgtaaaggagcccgattaaagaatctgtcgcgtacgggtctccttttcttcccatcgccgatacaacaacgacaaccttataaccttcacttatggcatcttttatgtgtgctagcgcaagcttgcggcctttgtcatcttttacggatgttccgccgaatttttgaacaatgatcttcactattttcactccaaattagtctgacgtaacagaagagagcaggcagagccttactctcttctgttcgcctatagaaaatacgtttgttttatacgaggttcagtttttgcaggctttccgcgatttgaactgagttccaagcggcgccttttaacaggttatcagaaacaacccacaaatgaaaaccgtttgctctgtccaaatctttccgaattcttcctacaaatacatcgcgtttgccgacgcaatcagcaggcatcgggtaaagctgctccgccggatcatcctgaagcgtaacacccggagcttcttttaaaagctgtttaatatcttcaacggttgcgtcatcacggtcaagctcaatgtaaacagattctgaatgccctgtttcaatcggcagtcttacacatgtcgcagccacttccagcttcggcatatgcatgatttttttcgtttcattaatcattttcatttcctcaaacgtatagccgttgtcttggaatttatcaatttgcggaatggcgttaaatgcgatttgataatgctttttgtcgcctttaaccggcataatggacggttctgcgggttcattgtttaaaatcgcctttgtctggctgtacaattctttcgccgcttcattgccggctccggacacagcttggtaagtagatacaatgacttttttcaaaccgtacgctttgcggatcggttcaagcgcagccaccatctgaatcgttgaacagttagggttggcgataatgccgttatgtttgtgcagatcaccttcgttcacctcaggcaccacgagcggtgtattttcgtccatacggaatgcgctcgtattgtcaatcacgatggctccccgttttacagcctcaggcgccaagctttgtgatacgcttccgccggcgctgaataacgcgatatgaacgccttcgaagctttcaggaacagcttcctgcactgtatattcttcgcctttaaacgttactttcgtaccagcagaacgctttgaggatagtagtgtgagtgtttcgatttcaaagtttctgtcttccagtgttttcagcatttgctgtcctacggctcccgtcgctccgacaactgctacgtgtaatcctcttcccatctgtaaaactccttccgccaattaagcatcatttgttgaattgactttgcattttacgttttattttaccatagaatagtcacggattgaccgaatttttttattccggaatgattttctgtcatcatgattttttattcatgatggtgtacgagcaccggctgaacctgctggtgcaaaagagctttttctaccgtaatcggaaggagatccattctggcgacgagcgatgtcggttttttcacgtggtcatcctggccgaacgggatgaaatatatgttttttgcggacatcagcctcattaaattcgttccgtttaaaccgagtccgtcatttgtcgaaattccgagcacgaccgggcggccgttgcggatcgtggctttcgcagccataaggacggggctgtcggtcatcgcatttgcgagtttgctcattgaatttccggttaaaggggcgatgaccatgcagtcgagcggaagtttcggcccgagtggctccgcttttacgatggaatcaatcgcctcaaagcctgttgtttcttcaatttttctgacccaatctcccccctccccaaagcgggtatcggtcgattgaacggttgatgtcacgaccggccggacttcagctccttgactgataagcgcctctatttgcggaaacacttcctcatatgtgcaatgcgagccggttaatccgaatccgattcttttccctttcagagacatggttatttcccctctttctttaagtctgccaaaagcttgctcaatacgttcgcaataatctgtccggctgttttcggggccacaattcccggaagacccggagcaagcagcgctttaatgccttgtttttcagcatatttgaaatccgttccgcccggacgggatgctaaatccaaaatcaaggtcttgggcgtcatgcgcgataaaacgctttgattcagaatcaagctcggtacggtgttaatgcagatatcaatatcatttacatgatcagtaagctcttcaagttgaaaaggagaaagccccatttccgatatacgggctaaatgagccgaactccgcgcgcccacttttactttcgcccctaacgctgcaaacgtccgggcgatcgtcataccggtgcgccccatgccaagaacggcgacatttgatccgtgaatggtataatccgtatgctgaatcgccatcatgattgttccttcaacagtgggaatcgagttgaatatcgcgatgtcgtcccgctcaaataatttcacaagcttacggccggcttcgctggcgatcccctcaagatacgcgttggagatgcctgaataaatgacgcaatgctccggtgtccgctcaagatagctctgctttaataccacttcttcatttgaaaaaaccgtggaaacaacgccttctccggtcgttgccgatacaggcaggatgatactgtctattttttgaaagggaatctcatcaattttgcatttgacggttcctgtaaaaccgtcatccaattggtcaaaccctgcaagataaatatcggcatgctgttctgtcagctttcttataatctcaagctgtcttgcgtcaccgccaatgatcgcaattgttaatccggttaacatctgaaacgttcaccttctttacagttactggatcctttaagtgtcatcctcctcttcatcgtatgtgcaaagagaaagggcggtgaatgtacagcgtctttttcataaaaaaagcaccggctgtatgagccggtgcttgcaaaaaatgaataagatctactcttcgggaggcgtgatctcccccggaacgtctaaaatgatcatgtctgacccgattttttggatatggttccaggggacgcggatgtcgtggccttgttttcgcagtccgaaccattttaccgtcggtatcaacagcgcggtaatttgtccgtcctgttcattaatttccaaatcggtctggccgagcacgccgagccgctctgcccgtttaatatccacaatttctttacctgacagttcactgagcctcatgatagccacccccttgtactatatgacccggagcaaaaaaaaatgcctgccccgtacagaggcagactgctttgcagcttaagacgaggccggtatattgccggtcgggctgatgagcgatagtgcgtaatcatccgtaaataagcggcggctgaggccgttgacgctttccaggctgaccgcatttaattcagcgataatttcatccatggtcttatgctttccgagcaggagttcatttttcccgttccggctcattttgctgtttgtgctttctaagctgagcattaagctccccttcatttgctctttgctgttttccagctctttcggggtgataccgtcacgttttagaaccgataacgtttcctgaatggtttcagacagaagtccgagctgattcgcgccggtgcctccgtaaatcgtcagcataccgctgtcttcataggaactgtgatagctgtatacagaataggccagtcctttatcttcgcgcacatcctggaaaagacggctgctcatgcttccgccaagcacgttgtttaagacgatcaaatcgtaaatgtccggatctccgactttcaggcctttgaaaccgagacagagatgcgcctgttcggtgtctttttttctcgtcagcttttcataatgaaactcaggctcgctgatgccgcttgctttgcccttcgcttcgtatgtaccgaaccatttctccacgtctttaatgaattgttccgttacatttccggcgacagaaatgacgacgcggtccggcgtgtaaaagtcatccatatgctgtctgagagaatcgccgttaaacgacgaaagcgtttcctccgtcccgagaatcgggtatccgagcgaatgattgccgtatgtcgctttgctcagcagatcgtggacaatgtcatccggtgcgtcttcatacattttgatttcttcatatacgacgttcttttcttttttgagctcatcttcgtcaaaagcagaatgaaagaacatatcagccagcacatcaagtgcgtagtttgcatgctcatccagcactttggcgtaatagcacgtatattcttttgaagtgaaggcattcacttggccgcctatccgatcgaaggattctgcgatttcacgtgcggacctggtatttgttcctttaaaaaacatatgctcaagaaagtgcgaaataccgtttgtctccggcgtttcatgacgtgatcccgtcccgatccatacgccgattgccacagaccgcaccgttggattattttcaagcacaactcttacaccgttttggcatgtatagcgttttatcaagtctgttcctcctattcaaagacaggcagctgcctgctacttcatcagcctgttttcatccattaagtcagacactgagccgagcgcgtagcctttttctttgatttttgcaatcagtgtatccaggcttttcgcagtcggatcagtcggatgcattaaaatcatggctccgttatgtattttgctcagcacccttgtttgtaaaacagcgggagacggtttttgccagtcaatggtgtcaacggtccacatgatggtgcccattcctttttccgccgcaaggtcgaccacggcttttctgaagctgccgcttggcggcgcaaaccatttcggcttcatgccgagcgtctcgctgatttgtgcattggttttgtcgagctgttcggaaatgcttcctgaagtcagtttgctcatatcagggtgattgtatgaatgatttccgatttcatgtccgtctgccgctatttttttccccagttcctgattgtttttcagccatttcccttcaagaaagaaagttgctttgacctggtgctgcttcagaataggcagcatttgctccacgtattcatttccccaggcgacatttatcaggaaagcgaccatcggtttgtcgggatttcctttataaatgggttcgggcgcgagagaatcaagatggactttcggctttacctgctcatagacaaggtcgtcttcgtgaaattctccgtcctttttcatttgtttataggatttttccacattgacttttaaaccgttatatcccggtatactcttccatattttatcaatccgagcgtcttgcggcttcacttcatactctgacgctttttgcagtaattcttcatagagcggatcttttgatgatgacacagttaccgcgtcttttttcattgcgtctatgtaatcaactgtatacgggttttttaacatttcaaacgaaacaaaaaaaagaaataaaaaaacggcaaacggcacgaattttttcaacatgtccttcccccctcatcacacattatgtatgaggaggacaaggtagaacccgtctgttgtctttctcaaaataaagaagccgggtctcccaggctccttgttaggttttcatttaagattgttgttgttcctgttctttttctttctcttcgcgcagcactgctttacgcgacagattcactcgtccctgtttgtcaatttcagttaccttcacaaggatttcgtcaccgattttcacaacatcctcaaccttgccgacccgttcgagcgctagttcagagatgtgaacgagaccgtcttttccgctgaagatttcaacgaaagcgccaaatttctcaatccgtttcactttaccgaggtaaagctggccgacttcgacttctctgacaagatcttcgatgatttttttcgctttttggttgctgctttcatcagtagaagaaataaagatggtgccgtcttgttcaatgtcaattttaacaccggtatcttcaatgattttgttgatttgtttaccgctcggtccgataacgtcacggattttatccggattaatggtcatcgttaaaattttcggcgcatattgagaaagttcttttcttgattcaccaagcgtgctgagcatgctgtccaagatttccattcttccttttttcgcctgctgaagcgcttcttcaagaatttctcttgaaaggccttcaattttaatgtccatttgcagcgctgtcacgcctttttccgtgccggctactttaaagtccatgtcaccgagggcgtcttccatcccttgaatatccgtcaatactgtatagtactcgcctgatttcacaagtcccatcgcgatacctgcaacaggggctttaatcggaacacctgcgtccatcatggcaagcgtacttgcgcagatgctggcctgtgaagtggaaccgtttgattcaagcacttcagatacgaggcggaccgtatacgggaagtctttttcattcggaatgaccggctcaagcgcacgctctccaagagcaccgtgaccgatctcacggcgtcccggtccgcgcatcgggcctgtctcccctacgctgaactgcgggaagttataatgatgcataaagcgttttgactcttccacgcctaaaccgtcaagaatctgaacgtctccaagggcgcctaatgtacaaacgctgagcgcctgcgtctgtcctctcgtaaacagcccggatccgtgcgttctcggcagaaggccgacttctgaagaaagcgggcggatttgatcaacgccgcggccgtccggacggactttttcttctgtgatcaaacggcgcacttcgtttttcacgagtttagacagtgtctgtttcacttttttaattgtatcttcatcatgctcttcttcttcgaatttcgcgacaactgcatttttcacttcattgatcgcgtcttcgcgagcatgtttttcgtgaacctgaatggcgctgagaagatccggctccgcaaggctttttacttttgcgctgagctcttcgtcaatttcatacagttcgatctctgttttctctttgccgactgctgcgacgatttcttcttggaatgcgatcaggcgcttaatttcttcgtgaccgaacataatcgcctcaagcatgatttcttcaggaacttcatctgctccggcttccaccatgttgatggcatcttttgtgcctgcaacgatgaggttgatatcacttttttcaagctggtcaaccgtcggattgatgacgaatttcccgtcaatgcggcctaccgtcacacccgcgatcgggccttcaaacgggatatcggaaacgcaaagagcgagtgatgaaccgaacattgcagccatttcagatgagcagtcctgatcaacactcatgacaatgctgatgacctgtacttcgttacggaatccgtctgcgaaaagcgggcggatcggacggtcgatcagacggctggctaaaacggccttttcacttggacggccttctcttttaataaaaccgcccggaattttacctactgcgtataatctttcttcatagttaacggtaagcgggaaaaaatctagcggtttcggttcttttgatgcggttgctgtgctgagcactgcagtatcgccgtagcggaccatgacagcgccgtttgcctgtttggcaagctggccggcttctactgtaagctgtctgccggcccaatctatggtaaagacatgtttctcttgtcccattcgattacgagctcctctcttaatgtgtgaaataatcaattactcctattatgaacgaaatgaattgaacatatcaatgtcaaagtagtatgtaaaaggatttcattgtttttttattatttttttcgctttaatacgataaaaaagcgggaatcctcccgctttttacgattatcgacgtaagcctagtttgttaattaactcacggtaacgagttacgtctttattacgcagatacgtaagaagattacgacgtttacctaccattttaagaagaccgcgacgtgagtggtgatctttcttgtgagtacgcaaatgctcgttcaagttgttaattgagtctgttaggatagcgatctgaacttctggagaaccagtatcagattcgtgtgttttgaactcgctgatgagttgatttttacgctcttgagtaattgccatcctgtttcacctccatatcataattagccccagttacctagcaaccgtcggtgacttcggattgccaagcaatggttttaagactacgaaacatatgatactaaaaatcgcgcccatatgcaaatcttttagaataaaatttgtgtacttttgatgttttttccgttatttgctgaaaaaacggatcgcttcttgtttgtctttcccgatctgagccgtcagttcatcgatgccgttaaacttccgttcgcttcggattcgtttgtaccactcgattttaacgtcttctccgtatacatcctgttgaaaattaaacaaatgaacttcaattgacggctgatcgggacgcttttcataaaaggtcggtttgtagccgatgttgcagacgccttcatacacctcgccttttatttcggctttcactgcatacacgcctgtcggcggcacgatatagctgttgtgcaggccgatattcgcggtcggaaaaccgatggtgcggcctctcttgtctccgtgaatcacagtgccccggataaaatacggctgaccgagaagagtgtgcgcaagttcaacgtcaccatcctggagcgctgaccggatataagtggagctgatctttctgtcctgctcggtctgtttctcgacagtcgtgcatccggccttgccgtttaaatcgtccggcagcgtctccatcgtgccttttccgtattttccgtacgtaaaatcgaagcctcccacagcgtgccgcgcgttcaaccctaaaatatactcctcggcaaactgttttggagacagagacgcaaacgcttcatcaaactttacgacatacagcacatcagcgcctaaacgcccgatctggctgattttatcttcaagcggcgtaatcagatcctttggctctttgtccctgcccaacacatgggaagggtgtggatgaaacgtcataacggccagcgacaggcctttttcttcggcaatttgtctggctgttccgattactttccggtgtcccaaatgaacgccgtcaaagtagccgagcgccatgacagacgccggctgctcttctttttgtaaatgatgcggatgagaaatatgtatcgtcttcacagaacggtcaccttttttcttattgttcgcttttttgcatgagcactttagccggtttcagcagtcctttttttgaaggatgcggcatataaatggccacacattctccgtcttcagtacagaccgctatacgggcgtcagttgtcattgcagaaaattccgccgggatgtcaaacactgacccgttttcagctttcttagctaatgtatcacttatgacccatttcggcaaatgattgagcgctctatcgatcggcacggcatgctctgcaaccgttccgtccgaaacctgctgttcaagttcctcaaacgtgaaacattcatcaaggctgaaatcgcccgaagcagtgcggatgagatgcgacatatgcgcgggatagccgagtttttcaccgattgtcaccgccaacgttctgacgtaagtgccttttgagcacgtgactgtaaagcggaatgatgctgtgtcttcgttataagtgacaggggaagtgagcgcgatatcttcaatcgtgatattccgcttcggccgctccacttcaatacccgctctggcgtattcatagagctttttcccgttgacctttaccgcggaatacatcggcggcacttgctcctgcggtcccttcaattcgtctaaaacggctttgatatccgcttcttccagcggctccctgacaggctttacgctgaccgtttctcccgtctgatcttcggtcgatgtggagaaaccgagagtgatctcagcatcgtacgtttttgacttgtcggtgacgtactcaacgatctttgtagcccgtccgacacagatcggcagtacgcctgacacttccggatcaagggttcccgtatgcccgactttctttgtttttaacagttttcttattttcattacacagtcgtgagaagtcatgccgaccggtttatgtaaaaggagaactccgttaaccatctgtctttcgctcctttgttatcaattgtatcccgtaaaacgcagaaaagaggacagacgacactcgcccatcctctttcccgttattcagacggtttatctgaatgcagttcgtgaatcaatgtttcaatacgattgccgtactcaattgattcatcaaattcaaattcaagctcaggcgttttgcggagtctgattcggctgccgatttcggaacggataaatcctttcgctttctcaagccctttcagcgcctcttctttctttttctctccgccgagaacggagatatacaccttcgctatttgcaaatcacctgaaacacgtacgtctgttacagtgagaaatccgattctcgggtctttcagctttcggctgataatatccccgagctcttttttcatctgctcgccgacacggtttgctctcatactcaattcaatcacctctaagttaaaaccactctgttctagtgatcgtccgttctatctcgggaaaggagtcaataaacgcgagtacgcgctggatctccttttccgcctgaacgtgagaggaagagacgacagcgattccgaagctggtccgctgccaagtgtcctgatagccgatttctgcggccgacacgttgaacttattctgaaccctcgttataatccgcttcagaacggctcgtttctcctttaatgatcccgcatcataaatgatgcattcacattccgcaaatccgatcactttctttcgatttcctgcatgacatacgcttcaaggacgtcgccttcgcgaatgtcattgtatttcttaatcgttataccacattcatatccttgtgaaacttctttcacatcatctttgaagcgtttcagaacgtctacttccccttcgaagatgaccacgccgtcacggatcaggcggagtccgctgtcacgtgtaatgtggccgtctgttacatatccgccggcaatcgtgccgattttcgacactttgaatgtttggcgcacttcaacctgaccgatgactttttcttcgtattcaggatcaagcattcctttcatcgccgcttcaatttcttcgatgactttgtaaatgatacggtgaagacggatatctacattttcagcttcagccgtgctcttagcatttccgtctgggcgcacattaaacccgataacaattgcatttgaagcagatgcgagaatgatgtctgattccgtaatcgcaccgacgcctgtgtgaatgattttcacttttacgccttctacttcaattttttgaagagcggctgttaacgcttcggctgaaccttgaacgtcagcttttacgattaaattgatgtctttaacatcgccttgtttaatttgttcaaacagatcatcgaggctcagcttcgctttgtcgctgcgctgttcttccagttgcttggaagcgcgtgcttcaccgacagaacgggctgttttttcatctttaaagacgaggaattgatcgccagcctgcggtacgtcgtttaagcccgtgatttctacaggtgtggacggtccggctgttttcacgcggcggccgagatcattgaccatggcccgcacgcggccgaatgtatttccgacaacgatcggatctccgacatgcaatgttcccgtttgaacgagaagtgttgcgacagaacctcttcctttatcgagctcagcttcaataaccgttccttttgcctgacggttcggattggctttcagctcttccacttcactgacaagcagaatcatttcgacaagctcgtcaattcccttgcctgtaagagcggacagaggaacgaaaatcgtttctcctccccatgcttcaggaacgagtccgtattcagtcagctcctgcatgacacggtcagggttcgcgctttctttatccactttattcacggcaacgataatcggaacctcagccgctttcgcatggttgatggcttcgactgtttgcggcataacgccgtcatcagccgctacgactaaaatggtaatatcagttacttccgcaccgcgcgcacgcattgttgtgaacgccgcgtgtcccggagtatctaagaacgtgatttttttgccgttttcttcgatctggtacgccccgatatgctgggtgattccgccggcttcaccttcaacaacctttgtttttctgatgctgtcaaggagggtcgttttcccgtggtcaacgtggcccatgatcgtcacgacaggcggacggatttgaagatcttcttctttgtcagcctcttcatatttttcaagctcagtttcttcgagcacaatcacttcttctgtttccacaccgtattcagatgcgatcagttcgattgtgtctttgtcaagctcctggttaatggtagccattacacccagaagcatcagttttttaatgagttcagacggttctttgccaagttcttcggctaaggccccgactgttaaagagccggaaaacgtaattttctcaggaagctcttttttcggcttcagcggtttttgctgatactgatttttgttgttatgattgcgtttgtttttgtttttgttgttgttgttattcttcttgtttttgttaaattgattattctgcacgtcattcttctttccgtctcgaattttgtttggttgattcccagcaggctgctgattaatcccttgcggcttgtttttgttcgtttccgcaggcttctgagatgtaacgccggcgccgccttttttaaatttcgcatcaagctgcttaatggtcttttcttcaagcattgccatatggttatttactactatatccatgtttttcagcgcagtcaaaatttccttgcttgaaacattgatggcttttgcatattcgtaaactctcattttagccattcgttcacccccaaaaatattaatcgagcaagctgatcagcttattcgcaaaaccttggtcagtgacggcgacaacgacacgtgattccttgccgatagagcggccgagatccgcgcggctttcgacttttttataaggcactttataataattgcatttatcggatactttttttgcagtattcgcagatgcatcttctgtcagcagaacaagttttgcacgcgcatttctaatttcttttataaccaagtcctcgcccgacacgaccttacgagctcgattggccagacccagcaagggaaaccattccattccagacatgttattttttcaccttttccgccagttccagcaattcttcgaaaatctggtcatcgatttgtgattgaaattgattttgcaatgtgtttttctttttcgcagctaagatgcattctttctcaagggtgatataggcaccccgcccgttcttctttccggtcggatcgactgaaatctctccttctttagaacggacaattcggatcagttcctttttaggcttcatttcccccgttaccacgcatttgcgcagaggaattttttttcgcttattcacctaaagtcacctcttattcatccgattcggctgtttcaggctccataaagagcggctctaaatcgtcatcttcttcatgctctctcggatagatgccaaggtctcttgcatccgtttcacttttgatatcgattttccagcctgtcagtttcgcggctaagcgggcgttttgccctctttttccgattgccagagaaagctggtaatcaggaacgatgacagtcgtggctttttcttcttcgctgacgatgacatccagcactttagacgggctgagcgcattggcaacaaattcaaccggatcatcagaccagttgacgatatcaattttttcgcctttcagttcattgacgatcgcctgcacccgctggcctttaggaccgacgcatgaaccgaccggatcaacgtcagggtcatcagtgcggacggagattttagagcggtcgcccgcttctctggcaacggatttcagttcgaccgttccgtcataaatttccggcacttcgatttcaaaaagacgcttcaacaggccaggatgcgttcttgatacatagatctgcggcccttttgtcgttttttcgacttttgtgataaatactttaatccgatcgtgcggtttatagctctcattcggcatttgttcattgacgggcagcagcgcttcaatcttgccgagagacacgtaaataaacttgctgtctaagcgctgtacaattcccgtcatgatgtcttcttcacgatcgataaattctgagtaaatcacgccgcgctcagcttcacggacacgctgcgtcaccacttgtttcgccgtctgcgcagcaatgcggccgaagtctttcggcgtgacttctatttcaacgacatctccgacaaggtagttcggatggatgtgctgggcgtcgtcaagcgagatttcaagtcttgaatcgtatacctcgtctacgacatcctttcttgcgaacacgcggatcgtgcccgtctcacggttcagatcgacccgtacgttttgcgcctggttaaaatttcgcttatacgcggaaattaaggcagcttcaattgcttcgatgataatgtctttactgatgcctttttctttttcaagaatagtgagagcatctaatagttcactgctcatgttagcggtctccccccttaaacactaatacttcattcattaaaatgttacagctaatcttgcgttagctattttttcatacggaatattgacccgtttctttcttgttttgaccgtcatctctattgtaacagtttgtccatcaaattcagccaatttgccttcaaacacttttaaaccgtcaatcggttcgtacgttttcatgtacacatttttgcccagtgatttttcgaagtcggcttttttctttaatggacgctcggctccaggagaagatacttcaagaaagtagttctgagtgatcggatcggcctcatccagcttttcgcttaacgcttcgctgactttggcgcactcctcaatatcaacaccgttatcggaatcaataaacacgcgaaggaaccagttttgaccctctttgacaaattcaatgtctacgagttcaagctgaaggtcatccagtatgggctgagccattccttgaacggtatcagtcacttttttgctcatgtttttcctccttgtgctgtcgatatcatatcagccgttcctctgcataaaaaccctgcttctaaagagcaggggcattgagaaaacgatggacatgtcgaggcaaaattgcctgttcaatacaaaagagcgggtttccccactctttgcctcggtaatcgttagcatttccaataaaactataccataaccatatatttaatgcaaatcaaactccgctcggaggctgtgcacaaagcttaaaacagcgacagctgattttggtccggaagcgactcaagacagccgtgacgatctaaatactctaaaatggtttttgacacttttcctcgtttttgaaggtcctcttttgaaaggaactccccttcttcccgcgctttcacaatattgagagcggcgttggttccgagtcccggaattgagttgaacggcgggatgagactgttgccgtcaatgataaattccgaagcgctcgaacggtatagatcgaccttctggaaggaatagccgcgctcacacatttcaagcgcaagctctaacacggtaaggaggtttttctccttcggcgaagcatcaagccctttagagctgatatcatccatcaccgctctgatggcggttgagcctttaatcattgtatcaatgtcaaagtcatctgcgcggacggtaaagtacgcagcataatataaaagcgcgtgatgcactttaaaataggcaatccgcaccgccatcagcacgtatgcggcggcgtgggctttcgggaacatatatttgatttttttgcatgaatcaatataccagttcggcacattgttctttttcatttcttcttcccattccggcgtcaggcctttgcctttacgcacgaattccatgattttaaaggccagtgaaggctcaaggccctgataaatcaagtaaaccataatgtcatcacggcagccgatcacttcgctcagttcgcacgtattgttgtgtatcagttcctgcgcgttgccgagccatacgtccgtgccgtgggaaagcccggaaatctggacaagctcggagaacgtcgtcggcttcgtatcctcaagcatctgccgcacaaatcgcgtcccgaattcaggaataccgagcgtccccgttttacagccgatctgctcttcagtgacgccgagcgattctgtgccttggaaaatcttcataacttccggatcatctgtcggaatcgtcttcggatcaattccgcttaaatcctggagcatccggatgactgtcggatcatcgtgccccaatatatcaagcttcagcaggttgtcatgaatggagtggaagtcaaaatgagtcgttttccattcagaccccgtcgcatctgccgggaattgtatcggggaaaaatcgtaaatatccatgtaatccgggacaacgataatcccccccgggtgctggccggtcgttctcttaacgccggtgcagccctgcaccagacggtcgatctccgcgccgcgcatgtgtaggttgtgatcacccgcatagcctttcacatatccgtaagccgtcttttccgcaacggtgccgatcgttcccgcgcgatacacgttatcttcaccgaacagcactttcgtgtagttatgggcatggggctgatactcacctgagaagttcaagtcgatatcgggtactttgtcacctttaaagcctaagaacgtttcaaacgggatatcatgcccgtcctttttcaaaggtgtgccgcaagacgggcagcttttatccggaaggtcaaaaccggaaccgactgatccgtcattaaagaattcggaatatcggcagctcgggcacacatagtgcggagcgagcggattcacttcagtgatttccgttaaggtcgccacaagcgatgaaccgacggacccccgggagccgacgagataaccgtcatccagagaccgttttacaagcttatgagagatgagataaataacggcgaatccatgaccgatgatgctttttaattctttttctattctcgcttccacaatttcaggaagctcttcaccgtaaatgcttctggcgcgctgatagctcatttcacggatttcttcatcggctccgtcaattttcggcgtgtacagatcgtctttgatcggtttgatctcatcgatcatcgaagcgactttctgcgtattgtcaaccacgatttctttcgctttttccgcaccgagaaaggagaaagcatccagcatttcatctgtcgttctgaagtgcactttaggcagttcgtgccggtttaacgggttggcgccgccttgggaagatattaagatcttccggtaaattttgtcctcatcgtttaaatagtggacatttccggtggcaacgaccggcttattcaatttttccccgagcttcgtgatgttgacgatgatttctttcagcgctttttcatcccggacgagctcaagctgcagaaggtgtctgtatacttccggcggctgcacttcaagataatcatagaatgatgcgatatcttcaacctcttcaggtgatttttgcatcatgccttcaaagacctctcccctgtcacaggcagagccgattaacagaccttctctgtatttattaagctgcgacctcggaatgcgcggcactctgtagaaatattgaatatgagaaatggacacgagcttaaacagatttttaaggccggtctcatttacggcaagcaatgtagcgtgataaggccttgatctttgataagcattggattgtcccatattctcattcagctgatcatgataaaaaatgtctttttcagcggcatctttgagcattttcaacagcaggtagcccgttgcttcagcgtcaaagaccgctcggtgatgctgggttaattcgatatcaaacttcttacataacgtatttaagcggtgatttttaaattcaggatacaggaaacgcgcgagttccagcgtatcaataaccggatttttcgctttttccgttttcaaaagacgcttgtacgccacatttaaaaatcccatatcaaagctggcgttatgagccacaagcacgtcatcgccgatccattctttaaaatcccggacgacgtcaacgacatcgggagcgtcgcggaccatgtcgtccgttatcccggtaagctctatcgtcgttgctgacagcggatggtgcggattggcgaacgcttcgaatttatcgatgatttctccgcctcttattttgactgcggcaagctcaatgatggtgtcatacactgcggacagacctgtcgtttcaacgtcaaagacgacgtatgtgtcttcttccaaaagacggtgagctggattgtatgcgatcggaacgccgtcatccacgatattggcttccattccgtaaatcattttaatgccgtgttttttcgcggcggaataggcatccgggaaagactgcacaacggcatgatcagttaacgcaatcgcttcatgtccccattttttcgcctgttcgacaagctttccgatgcccgttacagcatccatttggctcatcggagaatgcagatgaagctcaacccgtttttcgccttcaggagcggtgtcttcacgggttttggcttttatttcattcacgtcatttgcaatcatgacgaggtctctgacgaatgtatcgttttgaatgcttccccgcgccttcacccacatgccttttttcagcgttttcatcaaagcggcgtcttctttttctctggcgaacatttttactaaaatactgtttgtatagtccgtgattttgaaaatgcagagcgtgcgtccgcttttcagctcgcgtgtttcagcatcaaacacaaacccctgcaccgtgattcttctttcttcatccatgatgctgtcaagcgtccggatttcttcgttctctttaatttgatagccgatgacaagcgggccggacggcgcttgatcctcatcgccctctttttccttcttctccatttcgataagcgcctgcatcgcccgctcctgatcttcagcaagcttttgctcgcggaatttctggacttcttggtcagatacgaaaatttcggtatccagctgcagttccggaaatccgaattggcgatagctgtgctgaatcagtgcgctgtatttatttttgagcgccgatgcttctgtatctgtttttgttttcacgatcagtttgtttcccttgagcttcggcttctgctgattcaaaagagccaccatcggcggcgaggttccttcaagctcttcaatacagcgtgtccaataatcctgtacaagctcctctgtcactgtaggatcgatgacctgaacagacgatgtgacacgggcgatgtgagcaaacgattgtgttaacctcatcatgaatgaatcgtatatttgatacggcaaaagagccttaaagcgaaattggaaatgccaggctttttctgctttatggattgtcagtttatcaatctctccgtcttcaaagtatgtcatgaaggtatcatctgtcatattaagctgctgcagaagaatctgaaactgtcttctgtttactgataactgttccattcagacagtatccctcccttaaaacatcataagtgaaggtacctccgcaggtgatgaggtaccttcttttttctctattttaacatgattttgtacgattcgttatggtgattacttcgtcttaataaattcagaaagctcatccactgaaacttcggcagattcaccggttttgcggattttcacttctacgatgccttcgtcggcacgttttccgacagtgatgcggatcggaaggccgatcagatcagaatcagcaaacttcacgcctgcgcgttcagcgcggtcatcgtataaaacctcataaccttccgcctggaattttctgtaaagctgttcagcaagctctttttgcgcttcatttttcatattcagcgccaaaatatgaagatcatacggagcaacgctcttcggccagattaagcctttttcgtcgtgatgctgttcagcgatggcagaaagcgttctggacacgccgattccgtaacatcccatcagcatcggctgcgcacgcccgttttcatcaaggtatgtcgcattcatcgcttcagagtaacgcgtgccgagtttaaagacttgtccgacctcaatcccttcagcgaaacggatcgtgccttttccgtcaggtgacggatcgccttcctgaatgattcgaagatcggcatacgcttttacagacgcgtcacgttcgatgtttacgtttcggtaatgacggtctttttcattcgcgccgcaaacggcgtttaccattactttcacggcttggtcggcataaatctcaatgtcgccggcagcgccgatcggccccgcaaatcccggctccgtgccaagtttctccgctacttcttcatgagacgcaagctcaaccacttccgcgttcagaaggtttttcactttcacgtcgttgacctcatgatcgcctcttactaacacgagaacaaatcggtcatccgctttaaacagcattgatttgatgcaggcgctcggctcgatctgcaagaacgaagcgagctcttcaatgcttttgacattcggcgtatcaattttctccaatgcctcgggtgtttcatctgacggctcgctgttcatgacaacttccgccatttccgtattggctgcgtaagaggatccatcggaataagcgatggtatcttcccctatttcagaaagagccataaattcatgcgtgtcttttccgcccatcgcgcctgagtcggcaataacgggacggacgtttaattcacagcgtgcgaaaatgctgctgtatgcgccgtacatgttttggtacgtttcctccagactttcttcagaagcatggaaagaatacgcatctttcatgatgaattcgcgtccgcgcaataacccgaaacgcgggcgtttttcatctctgaatttagactggatctggtaaagagtgagcggcagacgcttataagatttcacctcatcacgcacgagagaagtaatgacttcttcatgtgtcgcgcctaaagcaaattcacggccgtggcggtctttcagacgcattaattcaggcccgtacgtataccatctgcctgattcctgccatgtttcagcctgctgaagggccggcatcagcatttccaccgcgttgattttttccatttcttcacgcacgatcttctgaatgttttgaatgaccctgtaagccaggggcatgtagctgtaaaccccgctcgtattttgtctgataaatcccgctctcagcagaagcttatggctttttgcttcagcatcagccggcacttctctcagggtcggaataagcgtcaaactttgtctcatgtcttcgcacctctgattttttactagtcaattataagaataaacgctggatatcgttccatgtgacaaccagcataagaagcattaagaaagctacgccgataaatacgacaaatgcttccttgtcacggtttatcggcttgccgcggattgcttcaatgaataaaaacagcagccgtccgccgtcaagcgccggtatcggcagcaggttgacgattcccaggttgatgcttaaaaacgccgcaaactggaataggttgataataccggtttttgcaacttgatccgtcatatcataaatgccgacaggacccgaaagcatatcaagcttaaactggcctgtcacaagtttgctcagattggtcaggatcgcttttgtgacatcaacggtagatgtcgcgccgtaagcaatcgctgcaagcgcgcctttttcagtcggcgcataagagccgaagcggccgattgtttttttattttcatcttttacagcttcaggtgtaaccgagatatgaaacgatttgccatcccgtttgacggcgacatcgatttttttcccgggattttcttttaccgctgtcacgatgtcggtccatgacctcattttttcaccgttaatgctctggatatagtcgccttcttttaaaccggcagcagctgcgcgtccattgtctgtcagcttcccgagctcaggctgatttgaaggcacgccttgaatgaatccgagcatgacgagaatgacatacgctaagatgaagttcattatcggaccggcagcaatcgccttaatccgcttccatacgggtttagacccgaattgtcgattgtaaggcgcaatctgcacttcttctccgtctacgataaaaaaagaggtctgactgacagtaaagcccgccagttcatcttctttcccctgctcgtacccgataatcttcatttcgtgctcaagatcagccgtctccacctcgataattaaagcgtcgggatatttttccttttgattaatgatgactttttccacttcgtcctctttattaaaaagaagcccgacggtataaccgggtttgacttcgatcatctccgggtcttcaccggccatgcggacgaaccctccgaccggaaggagtctgatcgtatacacggtttcattctttttaaatgaaaagattttagggccgaagccgatcgcaaattcacggcaaaggattcccgctctttgggcgagcaataaatgcccgagctcatggaaaaaaacgagcgttccgaaaataataataaacgcgataactgtattcacgaacataccaccttatgtgagtattgaattaacgtatccccgggtgtctttgtccacttcttggatatccgcaagactcggatcctgaattacgctgtggcggtccaatgctttttcaatcaggtcctcaatcgataagaatgaaatccgtccggcaagaaaagcggcaacggcttcttcgttggccgcatttaaaaccgtcggcatcgttccccctattttacctgattcaaaggcaaattgtaagcagcggaacctttcaaagtcagctttcgcaaaatgaaggcttccgatctcccataattcaagcctttttgtttcaggcagaggcagccggtccggatatgtcagcgcgtattgaatcggcaccctcatgtccggatttccgagctgggcgatgacgcttctgtcgtgaaattcaaccatcgaatgaatgatgctctctttatgtaatacaacgtcaatctgttcatacggaatgtcaaacagccaatgcgcttcaatgacttcaagccctttattcatcattgtagccgagtcaatcgtaatctttgcacccatcgaccagttcgggtgattaagggcgtcggcaatcgttacagactcaagctcctgccgcgttttatccctgaaactgccgccggatgccgtaatgatcaggcgctcgatatttttgctctgttcgccttgcagcgcctgaaaaatagcggaatgttcgctgtcaaccggaagaagaggaacaccgtatcgttttgcgtgtcctttcactatatgcccggcagtgacgagagtttccttatttgcaagcgcaattgtttttttctgttcaatcgctttcaaagtcgggattaaaccgacgcttccaagcagcgcattgaccacgatatccacttcatccatgactgccgcttcaatcaggccttcttctccgatgccgatttgacattcatgcgaaaaagacgcttctttcactttttgatatgtatccatgtcgccgactcctacatatttcggctgaaacgttctgatcaacgggatcgctttctcggcgtttttaccgaaagtcatcgagacgagacggaactgatcttgatgcatgcgcaatacgtctaacgtctgctccccgattgatcctgttgctcctaaaagacaaatattcttcaaaatgccactcccattctatgcgtccagatcggtcttattttcatattagcctttctcatgaaaaaagcgcaagcagaaagtataagaacggcatgacaaacaaaaagctgtcaaatcggtctaaaatgccgccgtgcccgggaaggattttccccgaatccttcacatcatagtgccgcttaagcgctgattcaaccaaatccccgatctgtccgaacacagacagaacaagcgtgatgaccaaaagaaccggatatgaaatcggaaggtgtgcaaacagctgaaaaacagccgtaaaaataagggcgatgacaataccgccgagaaacccttccactgttttgttgggactgatttcgggccacagcttccgcttcccgagcgactttccgacgaaatatgcgcctgagtccgttgaccatatgacaacgcaggcataaaagatatacaaaagcccgtttgtttcaatgtttctgatttcaataaaataatgaaaacacagtccgatatataccgtcgcgagaacgataaacccgacttcgtcaaacgtaaaggtgtttttcacgagcaccgtatagctgagcagaatcaatacggcgaaaatcgttacttccattttcgcatcgaaaaaatgatatttgtccggcatcatatacagccataacaacaagaagctgatcagacccggaaaagaaaaaaatctgagctttttcatccgcaaaagctcaaaaagcgctatacttcccatcacgtaaacaaatacggtgaacggcaatcctccgaaaataaccaaaaataaaaatagtgccgctgccagaacacctgttaacaatctttgtttcatttccaccatcctctaaattccgccaaacctccggccccgctgctgaaattctcccactgcctgcagaaagtgatcttctttaaaatcgggccacaggacatctgtaaaaacaaattcactgtaagccacctgccaaagcataaagttgctcagtctgatttctccgctcgttctgatgagcagctccgggtcctggattgattctgtcattaaatgcccggaaaagagcgcttcatcaatgtcttcgatattcagcgtgccgcttttcacctgttcggccaatgcttttgccgcattgacgatttccgtgcgtccgccgtagttcaaagcgaaattgagaatcagcccgtcattttgttctgtatcttttacggccttctcaatcgccctgtacgtatgagaagggagcgcggattcatctccgataattttcacctgtacattttcctctatcaattcaggaagatacgtattcaggaactcttccggaagcttcatcaaaaagtcgacttccatcttcggtcgcttccaattctccgttgaaaacgcataaagagtcagaactttaacgccgagctgatttgcgagctttgtcaccctttttaccactttcattccttcatgatgtccggcaatccgcgggagtgagcgcttcttcgcccagcgtccgtttccgtccataataatggcaatgtgtgcgggaatttcacccttcagtatgtcttcttttgtataccgttctaagttggaagccgcattctgctgattcttccaatttttgagtatgttgagcatgagattcctccgtcacccaaaaaggttgcgttgctgatgatcaatgtaatcaacagtattaacaaaaaaaccccctgtaaacatgagagggtcttttcacattatctattgtacatagtttttcattaaacttccatgatttctttttctttgtctttcgtgacgctgtcaatttttgacacatattcatctgtcagcttttgaacgtcttcactggaagcacgaagctcgtcttctgtaatgtccccgtttttctcaagttttttgaggtcgtcgttgctgtcacggcggacattacggactgctactttcgcttcttccgcgtattttttcacgactttgacaagttctttacgtctttcttccgtcagagccgggatcgcgatgcgaataattgtgccgtcacttgtcggagttacgccaaggtcagctttcaggatcgctttttcaatatcgccgattgccgttttgtcatacggtgtgacaacaagcatacgcgcttcaggcacattgatggaagacagctggtttaaaggtgtttgggcaccgtagtattctactgtcactttatccaatagagatgggttggcacgtcccgcgcggactgacgccaattcacgtgaataagcggcaaccgctttttccatgcgttcttttgtttgtgttaatacttcgtttgacaacgttatttcccccttacgatcgttccgattgattcgccgattacggcacgcttaatatttccttcttccataatagaaaagacgatcagcggaatatcattatccatacatagtgaagaagccgtagaatccatgacttccagcccgtcttttaacacatcgagataagataatttttcgtatttaacagctgactcatcttttctcggatcggcattatacacaccgtcgacattatttttcgccattaaaatcacatccgcttcgatttcagcggcacgcagcgctgcggttgtgtccgtagagaaataagggtttcccgttcccgcggcaaaaatcacaacgcgttttttctccaggtggcggatggcttttcttctgatataaggctcagcgacctgacgcatttcaattgatgtctgcactctggactgaattccgagcgtttccaggctgtcctgcagggcaagtgagttcatgacagtagcaagcatgcccatataatcggccgtcgcacggtccattcctaagtcactgcctgtttttccgcgccataagttgccgccgcctacaactacggccacttcgacgtcaagctcagcgatttcttttacctgtttagcgatggattggataacagtcggattaatgccgtttccctgctctcctgccaatgcttctccgctaagctttaaaacgatacgattgtattttggtttttccataataacctccaagtgtaaacattgccgtttcctattatgcaagagaaaaaaaggtttgtaaatatagttttaaaaatagggaacacaagtagtgtcccctatactgcctgaaaagccgcgaaagattcgccaaggctttccgccattattttttcacttggttcataacttcttcagcaaagttttcttggcgtttttcaatgccttctccaacttcgtagcggacgtaagttttaacagatgcgtttttcgcagccacaacttgtttcactttttcgtctgggtttttaacgaaagcttggtctaataagcaaatttcttcgaagaatttgttcagacggccttcaaccattttagctacgatgttttccggtttgccttcttgaagagcttgctgagtcaggatctgacgctcatggtttgcttcttcttcagacacttggtcgcgggaaatataacgaggatttaccgctgcaacatgcatcgcgatgtcttttgcaagatcttcgtcagttgttccgctaagaacggataatacgccgatgcggcctcccatgtgaaggtaagcaccgaacgcttcgctgtcttcttttgtaagaacagcaaaacggcgaagagtgattttctctccgattttagcaacattgcttgtgatgtattcttcaacagtagaaccgttttccatcttttgacccaacgcttcttcaagatcagcaggagcgtttgcaagaaggtggtcagcaagcgtgttcagaagctctttgaagccttcgtttttcgcaacgaaatcagtttcagagtttacttctaagataacgcctttgttgccgtcagttttaataagagtagaaccttcagcagcgatacggtcagcttttttagccgctttcgcaattcctttttctctcagaaggtcgattgctttgtccatatctccgtcagtttcagtcaatgcttttttacagtccatcataccagcgcctgttttttgacgcagttcttttacctgctgtgcagtaatagccatttgaattcctccttatatgtgtaaacaagatatgtatagatacatttttcttgaaaaaaggtgataaaaggcagtccctcttatcaccttttgattaggttacgcagttgtcgtttctgtttcaggtgcagtctcttcagcagcttccgcttcttcttcgccttgcttcgcttcaagaatggcatctgccattttagaagtaagaagtttgacagcgcggattgcgtcatcgtttgcagggattacgacatcaatttcatcaggatcacagtttgtatctacgattccgatgataggaatgttcaatttgcgagcttccgcaacagcgatgcgctctttgcgaggatcgatgatgaataatgcatcaggaagatccttcatgtctttaattccgccgaggaatttttcaagacgctctaattcttttttcaattgaacaacttcttttttcggaagtacttcaaatgtaccgttttcttgcattttctcgatgtctttcagacgcttaatgcgtttttggattgtttcgaagtttgtcagtgtaccgcccaaccagcgttggttgacatagtacatgccagagcgtacagcttcttctttaacagaatcctgagcttgtttttttgtgccgacgaaaaggatttttccgccttcagcagcaaggtttttcgtgaagttgtaagcttcctctacttttttcactgttttttgaaggtcaatgatgtagattccgttacgctccgtgaaaatgtaacgcttcatttttgggttccagcggcgtgtttggtggccgaagtgaacaccagcttcaagcaattgtttcatagaaataactgacatgtgatttcctcctaataaaatggtttttttcctccgcttaggtcatttttgtgcagaactgccgtttgcagcaccctctgcataaatcgttaagcgtgtgtatttaacaccaagacataatataacacagctttatgcgacaatcaagaatcctttacagctttgccgcgaaattttaaaaacagctcgatttctgtctttccgctctgcacccgtttggcgatttccgcaggggtgagcccttgttcatataattctgaaacacgttcttcaaacgaatgcgcaccgttgttttcgtcactttcagcccgttccgttgcactgatgagcttttccatgtgatccggaatatcaggctcttttttcggttccggccggggttcggcgtcttctgcgtcaggcgcttgatcattccggctttttgtgtcttcgagtctttcattttcttctttcagctcaagcagaaacgctgcaagggtgttttccgtctcttcaagaatcttcttctgctggcgctccgtctccttgagggctgaaaacctcgtgtacagaataatgacggcataaagcagtacgccgtgaagcacaaagcttaaaagccataatagtgttgacatgtttttcactcgctaaccatgagttcattattgaattactttttcaagcaggtgctttaatttaaacagcgcctttgaatgaatctgtgaaatccgcgacgtcgaaaggttcaggacttgtccgatttcggtcaaagtcagttcttctttatagaataaactgacgacaagctgctctttttcagagagctcgtgaattttgcccgcaagctgagcgatcagctcgtccttcatgattttttcttccggcggcacatttttgtcatctctgatcatcacttgaatattctcaccgtcatcctggtcgtgaagcttttcatcaattgataagagattggcaaaaaaaccttcattcatcgttgatactacgtcctgctccgtcatcccaagctcttctgcgatctctgaaggcgtcacattccgaaggtagcgctgttcaagtttttcgattgccgcttcgactttttttgtcttctcccgtgaagttctgggcagccaatcttctttacgcagcccgtcgatgattgcaccgcgaattctaaacgaggcataggtatcaaattttaaatcccggccggggtcaaatttttctagggcatcatataaaccaagcataccaaggctcattagatcgtctttatgcaccgatttcggcagtccgacggaaattctgccgacatgatatgtgaccagcggcatgtaacggcgcattaaatcatcaccggctttaggatctttccactctttccagcgcgaccaaagcacctgatcttcataattcaaggattgcattgttatccccctacctcatacctttattaaatcgttgtttcaccttgtttaacagttcgaatgtgcagcatgcaggactttggctcaaattcaatcgtccggccgcttgagccgcccgtatcttcactgatgaccggaatgttatacaatgaaagctgctctttaatagccgctacattcctcggaccgattttcatcaggtcgtttgtcattttaaacttaaacatctccgctcccccggcgagttttgccttcagggcaaacttgcggcagccggctttcaaaagcatatcaattgtcatcttaacggcggtgtccgcgtattttgcacggttgagctccgccgtttttgataaaccggagtccggcagcatgacgtgaacgagtcctgccgtttgtttgtctttatcgtataaaaccagccccacgcatgaaccgagtcccgaagtccggattttatccggataacgcgcgacttgaacatccgcaatccccactttaacgactgcggcttccgcacggctcataaagccgcacccaatgagacgaagagcttttcaaaagaatcatagtccgggagcataaacatatgggctttgagctcctgccggctgccctggtcaaaaatagaagtatccacgacaatggcatgctctccgacttggctgagctccatcagtccttcactgataaccgcgccgaacatatcaagtgagatttccggcacgctcgggtaaatctcaagctttgtcaaatcagccaatgccgttaaataggagcctgctaaaatattgccgaactcatgtaaagcagaagaactcaaatgatcttcgcccaactggtcaatatcaaaatccggatttccgatcagctctctgataaactgttccgcctgatggaaaggcatgatgagaaagatagagcctgtcatgtcgccttccattcttaaaaagatactggcgaccggcgtttcagccccgccgaaaaaatcagcgagctcatcaaatgtcaataaagtcgcaaacggcacttccatgtctatctttctgttcagcagctgagccatggcagaagccgagtgacccgccccgatatttccgacttcccgcaaaatatccatctgctcttctttgatcgcttcaaacttactcatgttgtcttttcccctttaagcattcggctctccggacgcagatgccgaagcacctttatccagcaccgcatgcgcatcaataatattgaggagcctgttatcttgcttgacgatctgtttaatccacacatccgtttcctttgtctggctttcaggcgcggattcgatttcattttcatgcacggtgatgacgtcattggcctcatccacgacccatccgacatcggcgtcacggtaagaaatgatgataatccgtgtctcttctgtgatgtcctgttcaggctggttcagacgttttcttaaatcaagaaccggggtaattactccgcgcagattgataacgccgcggatatacgattccacacccgggaccctcgtcggtttttgccacttttcaattgatttcacctgggaaactgagatagcgtattctttcccgtttatcataaacacaatcattttttcacctgttttgatttcagcagtcatgcgggcacctcctcgtgtcgttttagtagatcagcgcattgcaatcaataatcagcgccacttctccgtttccgagaatcgtagcgccggaaatcgcaaagacgttcgtcaaatagtcgccgagtgatttcagtacgacttcctgctgtccgataaaagagtccacgacaaaagcagtggatttatcgccctttttcacgacgattacatggaactgatcggcatcctgttttgaatccgtaatgccgaattcttttttgagatagacgatcggaacgatttgtcctctgaaatcaatcacttctctgtcatgcgtctgcaggatatctttcttatcaataacagccgtctctataatagaagaaatcggtatcgcaaacgtctcttcttccagtttaatgagaagaacggatataattgaaagtgtcagcggaagctggatactgaaaagagaaccttggccttccgcggatttgacactgacagagccgccgagtgattcgagtttattttttacgacatccagaccgacgccccgacctgaaatgtcagaaatttgatcggcagtcgagaagccaggagcaaaaataagctcgtaaatctcattatcttcaagcgtttcagcatcacgttcggtgattacactccgctcgagcgctttttcaagaattttctttctgttcaggccggccccgtcatcttcaacctcaataaagacatgattgccgctgtgatatgccttaagcacgacatgacccgattccggttttcctttattcacccgcacttcaggcgattcaatgccgtgatcgatgctgtttctgattaaatggacaagcggatcaccgatttcatcaatcaccgtgcggtccagctccgtttcagctccgatgatggacaattcgattttcttgtttaattccttttgaagctggcggatcattctcgggaaacggttaaagacggtttctaccggcaccatccgcatattaagaataatagactgaaggtcgcccgaaattctggtcaggcgttcaacggtttcagtcagctcattgtggtcaagctctttggcgatctgctcaagacgtccgcggtcaatgacaagttcttcaaaaaggttcattgaagaatccagtctttcaatgttgacgcgaatcgttttcgagccgctgtgatgcttcggctgctcttccgttttcgcttgcggtttcggctgtttttcagcctttttaaccggagtttccttcaccggttcagctgcttgcggtttttcggccgtttttaacggcgcaccggcagaaatttcgacattctccacttctgaaatgccgctgatgagttctttaatttcttcagcaggctgctttgtcaagaaacacacctgaaaatccgttccgaaatcttccgtctcaagcacttccgcggcaggtatcgtttttgcaacttccccggcttcattcagcttttcaaatatcatgtacacgcgcacggctttgagcatgcagctttcattcagggaaaccgttatttcatagcggctgaatccttgctcttccgcctcttcaataacagtccgttcgaactcatcataattccattcagttgaagtctgttgttttgaagccggcggttctgctgtttcggctgaagccgcagtctcatgcaccgcatttacgtcgagcttcgcacttacttcagaaatatcacgtttgccgtctcctccgtcaataatggactgcaccatctcttcaagatgatcaagcgcttcaaacagcacgtccagccaatccgatgtaacgggcatttctccgttgcggatggcgtccagcacattttccatcaggtgggttaaatgcgccagatctgtatatcccatcgttgcgctcatgcctttcagcgtatgggcagctctgaagatgtcatgcacaagctgaaggtctgccggatctttttccaacagcagcagcttttcgttacatgtctgtaagtgctctttactttcatcaataaagacatctaaatattgattcatatccaattgattcacaccctctcttttttcacacatccggtgatggatgccgcgatatcttccacatgtttaatctcatgaatgaggcccgcctttatcgctgacttcggcattccgaacacaacacaggattcgtccgattccgcaatcgttttaacgccgcctgttctgagcatttcttttacgccctcggttccgtcgctgcccatgcctgtcataatgacggctaccttttcgtaaccggataaacggcttgccgaccgaaacaaataatcggctgacggtttatgccggctttccgtatcatgaacatcaagaatgatgcggagccttccgccttcctctgcaaccgtcatattttttccgccgggcgcgatgtacacccatccgtctttcgcttcttcaccgttttccgcttctttgacctgaatatctgacaaatggttgagtctgtctgcaagtgaagcggtgaagccttcaggcatgtgctgaacgacaaatacaggcgcctttaaatccttcggcagtttcggaaccaccttttgcagagcccgcggtccgcctgtagaggtcgcgatgaatacggcctgcttggcggattttgctttcggtctttcaaatcccgccaaagccggacgttccgggatagaagactctttcactgccgcctcaggtttttgtgcgcgggacatcccggctgcaatcaccctctcaatcagctgctctttaattttataaagatcaagtgaaatcgctccggaaggcttagtgataaaatcaaaagcgcccatttccaggcagttgatcgttcggtccttcccttgctgtgtctggctcgataccatgatgacgggaagtttatatatgctgatgatcttccgcaatgtatccgttccgttcatgaccggcatttcaatatcaagcgtgacaacatccggtttgagaagctctattttcttcagcgcctcttccccgtttctggctgtcccgatgacttctatctgcacttccgcagccagaaaatcggtaatcatctttctcataaaagctgagtcatcaacgacaagcacacgaatcactgtaaaatcctcctcaataaaaaagaagataatctctcaataaatgccggtttctcttctcttggtttgttttcttccgtttgaaacaagacatccgtcagaagacggacggacctgctggcttttgcttgaggactttttattaaaaaaggcacctggtcaatgacggcttgacttactagcggatcatcgggtatggagccggcgaaacgcacctccgcgcctaaaaacgtgtggatcgcatgagaaaggcggttgtacgtgtccagcgcctgtttttgagcgcgggcgcgattgacggcaatgtttacggtcagccgttcatccgcgagcaaaagatgtttgatcgcgctgtacgcatccataatggccgtcggctcaggcgttgtcacggcgagaatgtcttccgccgataaaataaacggcagctgttcttttgaaagtcccgctcccatatcaaacagaacgtaatcaaaatcgcttaatacagcggaaagaccattcataaaagccgaccacttctctctgtctgcttgatagaacgcctcaagccccgttcctccggatatgtagcgaaggcctttcggaccggaggaaagtgattgagccaacgcgtgccgattctccatcacatcaataatggtgcgggaagaagcagctccgatcagcacatcaatgttgcccattccgatgtcaagatcaatgatgagtgctttttttcctttttcctgcagggcaactgccatgtttaatgttaaattagattttccgacgccgcctttaccgcttatgacggctaatgtcctcgcttttttctcataaagctccggcttgatcatttgcctctctctcattttccttcttaatgactctgcctgatcgggtttcatgccaaaagcatccttacaaactcttttggtgaagccgataggatgtcttcaggcacatcctgtccatttgtcaaataggcggcgccgattcttgattccgacagcacttgaaacacggagccgagtgaggcggtttcatccgttttcgtgaaaatgaattgattgaccggcacaccggaaaactgtttcagcacctgtttcatatcttcatattttgcagatgccgataatacgagaaaggattgtaagcctgattcaaacggaatcatctcttgtaattccgtaatatactgctcttctttaaagtttctgccggctgtatcaatgaaaacatggtcgtattcagcgaatttttccagtgccttcagacattcttcctttgaatagcatacttcaagaggagcctgaagcagctccgcatatgtcttcagctgctcgaccgcggcaatccggtaagtatccgtcgtcataaaggcaatttttttatgctctgtcagcattgatgaggccgcaagtttcgcaagtgtagtcgttttgccggccccggttgaaccgaaaagcacgacgtattttgattgaatcccttcctgccacctgtctgtcgaagggagttttttcactaacaaatcctgcagctttgagctgacattatcttcagttaaatctccggaaacaattgaagaactgagcaattcactgagtacagcgttttgcgtatgatcaggaagcccggcttgcttcaatagtctctcggctttttttaatggttcagggagcacttctttcaaatgcgccagttcgccggaaatactttgatccggaaggcgcggcggctgaacaggctcagctttctccgccgtttccgtctttttcatttcttcagcggcagccggcggcgtttttctcgcttccctgacgtcacgatctaaaaccgctatcacttcgacggcctgctgcgaccgcagccccagccattttcgtttctttacttgtttggaatgtaaaataacggcatcattgccgagttcctttttgatttgcttcgcggcatcctgcattgaagcggctgtaaatttttttattttcattaaatatccaccactccaatgctctgtacttcaacatttgcttccagctcattataagaaagaaccggaagatcagggaaataccgttctaacagctgttttacatacattctgacagcaggcgagcaaagaagaatcgccgactcctgacggatggaaagctgctcggcctcgttagcgacagaacggatgatgctgtccgaaacctcagggtcgagtgacaggtaattgccctgttcagtctgctgaaccccgtctgcaatcgctttttccacccggcctgagcatgtgatgaccttcagcgtttcatgctctctcgcatattgtgccgtgatttgtttggcaagcgactgtctcgcgtattctgtcaaaaggtctgaatctgtcgttaatcttccgtaatcggcaagagtttcaaaaatggtcaccaagtttctgattgaaactttttctctcagcaatttggcaagcaccttttgaatatcgccgacagaaagagggttcggcgtgacttcctcaacaagcacaggataattttccttcagatgatcgatcagctgctttgtttcctgtctgccgaccagttcatgagcatgctgcttaattttttctgtaatatgcgtagatacgactgacgccggatcaacaactgtataccccagcatgtccgcttcatcttttgcagcttcgctgatccattttgcgggaagtccgaacgacggttcaatcgtttcaattccttcaatgacgtcatcttcaggcgtcggtgacatcgctaaataatgatccagcaggagctctcctttagcgacttcattgcctttaattttcaatctgtattcattcggctggagtgcgatgttatccctgatgcgcacaaccggaatgacaagtcccaattcaagcgcaagctgacgtctgatcatgacgatgcggtcaagaagatcaccgccctgccccgcgtctgcaagcggcacgagtccgtatccgaactcaaattcaatcggatcaatatgtaaaagctgcacaacgctttccgggcttttcagttcatccgcctgagcctcttcttcaagaatttcttcctcttcttcgctcggcttatccgctttggacagcatataagcgccgaatgcaagcagaccggcgatcggccccgtcagcagaatgccgatcggtgtaagcagaccgagcaaaagtacagttcccgcggctacatacaagagcttcggataagcaaacagctggcctgtaatatcatgaccgaggtttccttcagatgccgctctcgtcacgacaatccccgtagccgttgaaatgagcaaggccggcatttgagaaacgataccgtcaccgaccgtcagcattgtaaagtgagacgcagcttcttgtatgctcatcccctgctgcagcatgccgattacgattccgaaaataatattgatcatcacgatgatgatccccgcgatggcatcccctttgacgaatttgctcgcaccgtccatggcaccgtaaaaatccgcttcccgggcgactttttcacgtctgtgctttgcatcctgctccgtaatcatgccggcatttaaatccgcgtcaatactcatttgctttccgggcatcgcatcgagcgtaaatctcgccgccacttccgatacccgctcggcgccttttgtaatgacgataaactgaataataattaagataatgaagacaacaagccctaccagcacatttccgccgacaacgaaattcccgaatgtctcaacaacctttcccccttctccgtgagaaagaatcgaacgtgtcgtcgacacattgagcgcaagccgaaacagcgtcaataacagcagcaatgacgggaatatcgagaattgcagcggttcttgcatattcattgtggtgagaagcacgatcaacgcaagagagatattaatgatgatcaaaatacttaacaaccatggagggaatggaatcaccagcattgccacaatgaggacaacacttattaaaaccgataaatctcttgttgacatgctgtttttctctccttttgaatctgaaattcactatactttttgtttcgttttatatacataagccaaaatttccgcaatgactttaaaaaactcttccggcacagcctggtcaatgtcaacctgatcatataacgcacgcgcgagcggcctgttttcaatcgtcatgacatcgtgttctttggcgatctgcctgatttttaatgcaagatggtcgacccctttggcaacaatgtaaggggcgtccattttcttttcatcatattttaaagcaatcgcataatgggtcgggttggtaatgatgacatccgctttcggcacttcctgcatcatccgcctcatcgccatttcccgctgcttctgcttaattttggacttgataatcggatcaccctccgattttttgtattcatcttttatatcctgctttgacattctgatatttttctcatagtcaaaacgctgatataaataatcaagcccggccagcagcattaaagcccctgatcccgcaagccccatccaaagcgtgagcttagaaacgaaagtgagcacttccgcaggtgttaaaagcggaaggcggagaatatcgccataatgcagccagagcaccataaaggcggcaaaaccgaccacagtaatcttcaaaatggatttgaccagttcaacaatcgccctcatgctgtaaatccgcttaaatcctttcagcgggctgagcttattcaagtcaggcttgagaacttccgcagaaaacagaaaacccacctgcatgtaattgctcacgacacctgccacaagcgcgaccagcataatcggcgcgaggatgaggctgatatctttcaccgtatccacgaacagttcatgcacggcagatgctgacagatgtaatgatatcgatttcgtataaaacgttttaataaaggacagcagcctgtcccgcatataaggaccgagcgcgatcagcgaaagaaagataatcagtaaagaaacggctgtattcacatccgtacttttcgcgacctgtcctttctttcttgtatccttccgttttttcggagtggctttctccgttttttcaccggcaaagaattgcagattcagtcggagtctcatcatgtcacaccgaccaatgccaatagattccgcatggtttcaacggtaaggctgaagatgttgcggacgacgacaaacatcaccgccatacaaacgatcagcataataaagctcacggctattttcagaggaagcccgacaacgaaaacattcagctgcggcaccgttctcgccacaataccgagcgccaaatcaactaaaaacagactggccacaaccggcgcagacatttgaaaagcgataatgaacatggcattgaagctttttgcgataaaaagtccaaagtgatcatttccaaacgacggaaatgcctgatcaagcgggatatactgaaagctgtaataaatcccgtccaataaaagataatgggcgtttacgctgagcataaataacagcgccagcgtataaacgaattgtccgatcagcgggctttgcgttcctgattgcggatcaatgacattggcgatggaaaagcccatctgaaaatcaataaaggaacccgctatctgaatggctgtcatcatcatgaaagcaatcagcccgaggctcaagccaacaacggcctcttttatgacaagcagcatatactgttcccctatttctatttccggcgcatgtttcagcgtgctgaagcagatcaccgaaagaaaaaaagcaaagccgattcggtgaaccgccggcagattccgatgtccgaacaccggcaccgttacaaaaaaagcagagattctgataaagaccaataaaaaagcgggaaataaatcaatgatggaattcatttgattctaccctgcaaatcggttcagatgagagaacagatcagttgtgaacgaaagaatcgtcgacagcatccaaggaccgaaaaagatcagtccaagcatcaccgccacgattttcggaatgaacgcaagcgtctgttcctggatttgagttgtcgcttgaaagatactgacgagcaaaccgacgatcagcgcgatcgcaagcagcggcccgctgatcattagtgttacatatacggctttttccgccatggaaattacaaattctgaactcacaattagcacctaccctaaaagctgtcaagcaaagatttcacgattaaataccatccatcgaccaaaacgaaaagcaatattttaaagggcagagagatcataaccggcggtagcatcatcattcccattgacattaagacgctcgccacgaccatatcgataattaaaaacggaataaaaatcataaagcccatttgaaaagcggttttgagttctgatatcgcataagcgggcaccatcgtcgtcaaaggaatatcctgaatcgattcaggttttttcattttggcatagttcataaacagcgccagatccttctgccttgtatgcttgctcatatactctttaatcggcttctcggcttttgtatatgcttcatcgagactgattttgttgtccatcagcggcgttaaggcttccttattaatctctgaaaaagtcggcgccataataaaaaacgtcaagaacagcgcaaggccgattaaaacctggttcggaggcatgttctgcgtcgccagtgaggttctcacaaaagacagaacgatgacgattctcgtaaagcaggtcatcaaaatcagaatccccggcgctactgaaaagacagtcaaaagcagcagtaatttaacagtggagctgacttcggtcggactgcttgaattaaaaagattaacgaattcattcatgatgataagggcctttcttctttccttcagaacggctttgtttcagctcgttcagctgttctttcagcgcttttgaaaacgacggaagcatcgtttgcggctttttttctccatccttacgcggatttacgagcttggtccattccacttttgaagacatcgactcttcgtattggctcagaatcgcctcgcgctctttttcatcttcaatttcttttaaaagctgtatcgtttcgcccacaccgactacgagaacgctgtttcccactttaatcagctgcacggaacgattttggccgactgacgttccgccgatattttctacatattgaaacggcttcagcagacggtttcttctattcatcagtttgacaaatccatagatcagcagaatgacgaataataacgccccgatcatctttacaaaatcaaaagcggagacagaagatgcagaagcatcccctatctcttgatcagccgtttgtttcgatgtatcgctttttttctctgttttgtttgttgattgtttgtcaaaccattcgttgacggtggaattatcagactctgccgcaaaagcagggaacggatgtacattgagtaaaacgaaacaacaaatcaaagctagtaaaccatgactctttttcaacagtcgtacaccctttagcttaatgttttattaatggcttcaagcacgcggtccgcttggaacggtttcacgataaagtcttttgcgccggcctgaatcgcgtcaataaccattgactgctggcccatagccgaacacatgatgattttcgcctgcggatcgatctgtttaatttcctttagagctgtaatcccgtccatttcaggcattgtaatatccattgtcactaggtcgggggaatgctctttgaatttttcgactgcctgcgctccgtctgaagcttcagctacaacgtcaaaaccgttcttcactaaaatatccttgatcatcattctcataaatgctgcatcgtctacaattaaaattctgtgtgccataatctgtttctctcctctatgttcgcttattttaaattgttaaggcggtctgcctgacttaaaatatcagtgactctcacgccgaagttttcttctatgacaacgacctcgccctttgccacgatccgctggttgaccaggatgtcaacaggttcaccagccagcttgtcaagctcaataatgcttcccgcagaaagttcaaggatttctttgacgcttctcttcgttctgccgagctcaaccgtaacggaaagcggaatatccatcagcatatcaaggttattccttgatccttgcgccgcttcgttatgatcaaacgcctggaattctaccggagcgacttgaacaggagcagctttttttgcggttccctgtctcttcggaagctcgggttttgcctgcggctccggctgcatggcaggttccggctgcggcgtttcgtatgtttcctgtggttctgatgcggtttctgcggcctctgactcatgctggtctgcagtcatcaggtctgcgatcagatctttcgcaaacgtaatcggataaagctgcatgatgctcgaatcgattaattcgccgactttcagacggaatgacacttttacgagcaggtcatcctcaggtattctgtcggtccctttttcttccgtcacatccagaagttcaacccttggcggagaaatgtcaatctttttactgaatacggtcgacattgacgtagcagccgagcccatcatttgattcattgcttcctgcacggcgctcaggtggatttcaccgagtgacggatcggcgccccggccgtctccgccgatcatcaaatccgcgatgatggccgcgtcgctttgttcgacgacgagcaaattgctgccgtcaaagccttctgtgtagttcacttcaatggcaacatacggatgaggaaattcatcactgattttgctttttgaaatgacggtcacactcggtgtcgtaatgtccactttttgatttaaaagagtggacagcgccgtagccgagctgccgaacgaaatattcccgatttctccgatcgcatcgcgctcaagttcagacaagttcgcctcttgaggctgttctgtatcctctgactgactgcttgtgccgttaagaagagcatcgatttcatcttgagataatctattgttcatcttgttcacctcttatgtcgtgatctaaaatttgcactgcctgtcttcgattcacccggccggcctgccctaaaaacttcggtttgtttccgaccaatacagtaagaggatcagtcactgatttgtccagagttatacagtccccgacttccaaacttaaaaattcttctattgtcagttcagaagcgcccaagagagccacaacgggaatttgagccgtcatgatgcgcttttcaagcagcttcgtttcttcgggcttcgcttcattccggtctgattgcatccaataatgtacggaaagcttagggataatcggctcaagtacgacatggggaatacaaagattaatgacaccgctgatttcacctatctgtgtattgagagaaatgacaacgactgtttcatttggggaaaccatctgtacaaactgaggattcacttcaaattcagtcatttcagggtcaatatcagcaatcgattgccaagcttctttgtagttgcccagtgcattttcaaataagttagaaataatattcgtttcaatttccgtaaggctgtcagctttgttatgagtgatgccgatgcctcccatgacgcggtcaagcattgcgtatgcgatggtgggattaacctccatcatgattctgccttccatcggatgaacatcgaataaatttaaaatcgtcatgttcggtatggaacggataaattcttcatacggcacctggtcaactgagctgacggatatatgaatatacgttctgagcttggcggaaaagtgtgttgtgagaagcctcgcaaagttatcatgtatccgggttaaactgcgtatctgatctttcgagaatctgagagcccgtttaaaatcatatacctttacttttttctctttaacttcctttttcagctcttccgcatccgcctcacccgtggaaatggcggaaagcagtgcgtctatttcattttgggagagaacttctcctgacattttcttcacctccgtattctgtcaaatttgtttttattgcagattaaaggaggtaatgtacactttctgaacttttccttcttggagatagctgtttactttctcttttaatgattgtttaaacgcttctcttcctttatctccctcaatctctccggcgcttgtgtcagctaaaatggaaatgatgttgtctttcacctgaaaatcgcgtttttcaagttcttccttcgctttagccgagtcggtttcaagcttgatgccgatacggatgatgctgtcagactttaagtttgtcgtgatatcgtcgacagacacagtggctgcaacgacttcgtcaattgtcggctttttatctttgccggaatgtccgctgacgacaaaatatgctgccgttccgaggccggcgatgacaattaaaataatcagcaaaatgatgactaattttttcttcattcttcttcctctattccctgatccagtgaaaatatttgtatgctatggtaaaacgatatgacttttttgagaactgcttcttccggttctttcactacgaactttttgccgttggacagtgtaatcgtcgtgtcggggaagcactcaatctgttcgataaacagcgcgttcagcgtaaaaggctggccgtttaaacgggtgacttgaatcatgcaatccggagaagcggcctaaccgcctctcctccctccttaccgtttcagattaaccagctcctgaaggatttcatctgaagtcgtaatgatttttgagtttgattggaaaccgcgctgagcaacgatcatttcggtaaattcatctgtcagatctacgtttgacatttcaagatagcctgccaaaagcttacccgttccgttttcgcccggagtggtgactgcgctcgcagctcctgaacttaatgattctctgtaaaggttgcctccgattttttccagaccggcgctgttagggaacgtgaccagaccgatttgtccggcatcatgaaccgcatcccctgcatcagtgtatgtaacggttccgtctgcaccgatgctgtaatctttcgcatcagtcggaatattgattttgccgccgccgattttttcaaggtagtacccgtcagtcgtaacaaggttgccttgattgtcctttccgaaattccccgcacgtgtgtaaacgattcccgaacctgtattaatctgaaagtagccgtctccgtcaatggctaggtcggttttattctgtgtagcctgcggggcgccggttgaatgaacgacatcaatggaagaagtcgcggcacccaagccgatttgttttgaattggtcacgtttgaaccgccggcgactgtctggctgatcatatctttaaatgtaacgcggcttttcttaaatcccactgtgttgacattggcgatgttattgccgattacatctagttttgtctgaaagtttttcatgccgctgataccggaatataatgaacgtaacatgttaaattccccctgggtttctttttatttagatgtttcgctgacggccgtgacattccacggactgacctctttgccattttcaagcacgagcacgtaattgccgtttgaatgcttgactgaattgactgggcttgtctgatccttcccgtcgctgtcgctgaatgtgacatttttgccgatccagttcacatacatcgtaaacggatcttgattttctacaaatttagtcatcgtcgtattcatattcatcatttgttccaatgaagaaaatgtcgccatctggctgatgaattctttgtcatcaaccggattgagcgggtcctggttttgaacctgtgtcattaagatcttcagaaattcgtctttccctaaattcgtactgctgtttactgcggaggtgctcttcgcgtttgaagtggttgaagcgcccgccgcggcataatccgagtttactgatgtcaactattcttcctccatttcattgagagaaagctcctccagcatatctccgaaatcgcctgactgctgctggttcttctgctctctctgtccctgatgctgctgtttattgtgatcggccgtctgcccgtaaacagactgctgatccccgccttgaagcgggactgtaaaacggtcgacctggaccgacatattcggaagcgactgtttcagctgaggaagatgctgttccagcagctctttcgcggactggctggatgcgattattttgctttgaaacatcccgttttcgtttgtcaccttaattgtgacaaatccgaggttctcgggattaagacgaatcgtaaagcttccggttgttttcccgaaaggcgtgtatttcatctgtttccagccgctgatgacctgatccgttaacggtttattttctgccggctgctgttcagctcctgcggacgcttgctgaatgccggcaaggcttctcgttcccgaaaacagtatatgtgcagacaatttgctgtcaggcgcctttgcgtgagcaaccgtgccgccgttttgctgttccgttttcccggctgactcttgggatgattcagatgattgagataacacaaaagctttcagctcagtttcagccatatcccattcctttgttcccttttgagaaaggcccgcaagctgctccgcgacgctttgaaagctcttcagctcagcggctgtcatggagtaaagtttagatgcagattcgtttttcggaaaaaatgtctgccgcaggtcttgaatcacgcggtccggaacgccttgttttttcaatgcctctaataaacgggcgccttcctggtaaaccgcctttgcctgcgtgctgtccggcagttcctgctgagatgtgaagagctgggatatggcttcttgaatgaaaagcaggcccttctcaagcgcatccttgacggaatccccgtcttttgcggaagaatccggctcattcgtttcaggcttcgccccatgctgttttcccgctaacatgtcttcaagggattcggcaagctgtttcaataaaggaagagctgtttcagccgtctgctttccttcaagagcttttaccgcctcaagcagctgtttaagctgcaattctttatcttccgtgccggctttcagccaatcaccgattttcgatagggcatcattcagctctgcgtcacttgtttttgtttcatctccgggctgccggggagaagtgatttccgacaggagccagttctgaaatagacctaagctgtttacattcatcttcacattgctgttttgcgcagtctgcgtacgattacccgttaattcaagcagcttcaacttacatcactccttatttccgtcagcggatagtttttctgtatatttagccgcttgttcaggagtcattttcgtcaagatttcagcaagctgctttttacttaatccgtttaaaatatcgagggcttctttttctttcagctttacgataatgcttgccgctttaccgctttccatacttttatagatgttgatcattttatcttttccggctgaatccgaagcgtcttttttcgtttcatccgtcttcgttttctgctgctgttcagcttcctgtttcagcgaacggattttctgattcagattatcgatttcggacttgcttgtatctaaatctttattcaaaatgttaatttcacttttttgttcctttatggtcttttcaagagaagccgttctgtcttccttctgcttttccgccgcgcttttcatttctttcgtttcgggaaccaattcttttaaaacaggcgttttagcggctgtttcctgaatcggcttcatcacatcaacgccggcagcccaaaggatgatgcttgcgacgatgatcagaaaaatcagcgggatcatgataaaaagcaggattgaaccgaactttccagatctcttttctttatcggccatttcattcgctcctaatgcccctgaatcataaactgcttgattgaaatgtcgtccatttccctcatctctgcagctttgtcttcaagtgcgaacatattaaattgtttttcccgcattttttcaaatttctttacttcaatgtttttttcggtgagctgttcctgcttctcattcatttcatttcgtttcatgatgacaagcttttgataatgatagatggtgttctcaagattggaaacgaattgctgataatgtctcatttcctgaacgctcatcccgcatttcagctttgattctttgtctttttcgagcaattcttttttgctcatattttcatatagtttttcagccactgtctcaaattcagaaaccgattgtctgtattcagtcaatgtttggtctttttcattttcttttaattccagcagcttttgaaatctgaattggtacgccatgatgtttattcctcttttcctgtcagactcgtcaatgccgcaatgctgtcttccaattgagcaggttcttccgttccttgttttaaaaattgaataagctgcggataaaactgaatcgcttcatcaatttctcttgatgaccctcttttgtaagctccgatattaatgagatcttcagagttttgataagttgacagaagatcgcggaatttgttggccgcctctatgtgcgctgtgtctgaaatattggacatgaccctgctgatgcttttcaggatgttcacggccgggaactgccctttgttggcaagcgcccgatcgagaacgatatgcccgtctaatattccgcgcaccgtatcggcaatcggttcgttcatgtcatctccgtcaacgagaaccgtataaaaagcggttatcgttccttgttcatttgcgcccgttctttccagcaaacggggcaaaatagcgaacacagaaggtgtatatccctttgttgtcggcggttctcccgctgccaggccgatttctcgctgagccatcgcgaccctcgtgacggagtccatcatgaacatcacattccggcctttatcgcggaaatactccgcaatggcggtggccgtatacgccgctttcaatcgcattaacgcaggctgatcagaggtcgcgactacgactatcgagcgtttcaggccttcttcgcctaaatccttctcgatgaattcacgcacctcgcgcccccgttcaccgacaagtgcgataatgtttaaatcagcttcagtctgcttcgcaatcattcccatcaaggtgctttttccgactccgcttccggcaaaaatcccgattctctgcccttttcctaccgtcagcagactgtcaatcgatctgacgccgacacccatcttttcccgtatcggcgggcgtttcatcgggtttggcggcggctgttccgtcgaaacgggggacaaacctttcggaagcgcccggccgtcaagaggttcgccgaacgcgtcgacaacttgtccgattaaacccgcccctactttgatgcggagcgactcgccagtggcctccacaatgctgcccggcgctatgctggccgcttccagataaggcattaacagaatgttttcatcctggaagcctacaacctcagctttaatcgcttttttcgcatggcctttcggataaatgagacaaacatctccgattgagctttcgggcccttttgattcaatcatcagcccgatgacccgtttaaccttgccgtagcgtttgtacggatccgctgtttcaattgagtctattaaatactgtgtcttcattgctccgctcccgcctcaagcgccgttaaaagcttttgctttaattgcatcagctgagtgtctatgcctgcatcaacacgtccgaacggagtttctatcgagcacgttcccttcgcggctttttcatcggcatataagcttaatctgcattctttgtataacagctgctgaatttcgtccatatgctgatgaaccgtctcataatattcagggtccacatagatggagatgtcatcataatcttttacttcggctactacctgtttgaccagcagaaggaaagcctctttatcgtcacttttttgccgccatacttttttagcgagcgcaacagaaagctcaataatttcttcctcagcgctttccagtttttcctcgactgactgtctggccatttccataacggcattggcccggctgatgagattggcatattctgcttgagcatcggcttttcccaatgccatgccttctttatatccttctgccttcgcttcttcaatcaatctttgtttttcttccgcccagcggtttttctcttcttcaatctgccgaagagtgtgatccaattgacttttcgcttcttcagacaccctgtcggcttcggccttggcaaaggccatgagtgcctccggattttcaggttcctcccggtctggctgggaatgtgttttcctgacttcctgcaaggatagcttgcgccgtttttgttcaggagaaaatgatgattgctgtttaatgatattagacaataatatcgtctcctccgcctcgcgcgattacaatttctccggcttcttccagcttgcggacgacgcccacgattcttgattgcgcctcttccacatcacgcaaacgcacaggccccataatttccatttcctctttaaatgtttcaaccatacgctgtgacatattgctgaagacaatctctttgacttcctcgctcgcaaccttcaatgaaagcaggaggtcgtcgttttcaacatctctgatcacgcgctgaatcgcacggttatcaagggtgacaatatcttcaaagacaaacatccgttttttgatttcatccgccaattcaggatcttggatttctaatgaatcaaggatcgttttttccgttcctctgtctacgccgtttaacacttcaacaacggcttctatgccgccggtctgcgtataatcctgcgtaaaggaggaggacagcttttgttcaaggacccgctccacttcatttatgatttcaggagacgttctgtccataaccgcaatccttcttgccacctcagcctgaacgtccgggttcagctcagacaaaatctgtccggcctgcaccgggtcaaggtaggataaaatcagcgccatcgtttgcggatgttcctgctgaatgaaatttaaaatctgttcgggctccgcttttctcgcaaaatcaaacggctttacctgcaaagaagaggtgagcctgtttaaaatgcttaccgctttgtcttctccgagcgctttttcaagcacttggcgggcgtaatttaaaccgccttgtgaaatatagtcctgagcgattgcgatattatgaaattcttcaatgatttcatcttttctttgatgatcgacgcttctgactcccgaaatttcgagagtcaatctttctatttcttcttcagacaaatgcttgtacacagaagctgatacatcaaggcctaaggaaatcatgaggatggctgctttttgttttcctgtaagcttgttctgatcacgtttcgccattttccattccccctaatcctcgtccagccagcttcgaagcaatttagcaaagtcttccggtttttctttagccattttttcaagctgttttcgtctgactgtttcttccgtttcaattttctcttcgttgatatcaggcaatcgaaccggctccggcggtgtttcatattcatattcttcgtattcatcctcttgtgagcgtttctttctgataaggagaataataagcagaataatggccgcaagcagtacgccgcctgtaatatatacccagatcggaagacctgaagattgtgccgaatctgtgttcaggcttgtttttccgtcaaacggctgaacggatacaacgattttattgttgatatcattgtctgtcaggttttgattttgcgtttcgtttttatcaagagacgttctgacgaccgttcctagaatcttctgtatatcagcctgtctctgtgctgataaggaagcggcatttttcggattaggcggctccaccatgacctgaatgcctaaatcacgcactttatacgggctttccgcgatttctttatgaatgcggttgacttcatagttgattttattgctgcttttttcgtagtccccgctgtttgaaccgccgtttgtctcggcatagttcgcggtgtcattgcttcccgttccggccgtgccgccgttggccgcgccgtcgcctttatacgtttccgcgactttttcggcgcttaccgctatgccttccatgttatctttatctacaggttcgacagtgtcttcagtgcgtttttccttcgtgaagtcaatatccgccgttacggacacaacgaccttatcctgccccatcattgtgccgagcagtgactgaacatgtttttgaatgtccttttcgacctgcgacttaataccttgctgagatgcataactgtcagaaacggaccctgcaccgctgtcacttttgtcataatatgtagaattttgatccattatgacgatattatcttcttttaagttcggaacacttttagaaacgagatggtacagcccgttgatctggttttgatcaagcgagtagcccggtttcatctgcaaaacgatggatgcggacgctgccggctgatcttcaccgacgaacacggcttctttcggcatattgatcatgaccttcgagcttttaataccgtccatttcatttatcaggtttgacaattcggtctgagtcgcctcaacctttaaaacgtcaaactcattatctgtcaggccgaagcccgcattttgtccgaaaaacgaataatcaattgatcccgttttcggcaggccttccgcggcaagctggactttaagtgaatccacttggctctcaggaaccttaatgaccgtgccgccgtcagcaagttcagaagacacctttttcgtatcgagctcttctttaatcttccccgcttcttccgcggacaaatctttataaagaggcaccatcttttcagacgaagtaaaaataataacgacgatgagtaaaataatgaatgcggccaagccgcttaccatgagtatcttctgtgtttttgatctgttgttccaaaacgctgccgttttggttttcatttgcattagagtacgattcatgttaacccccggtcattccagtcattctcttcaatctgaccactacatctgcattctcatgatttcctgataggcttccacggctttattgcggaattcggtagcggccgtcagagagatatttgctttttgggcagcgatcatgacctcgtcaaggtttacatcctttcctgcagccagtccgttcgttatttggtcagattttacttgtgactcatttaacgaatcaatagagttttttaaaagctccgaaaagcttgtttggtttgaagaatcagttttttgagtttggtttaattgattcgttacgttttgagtgttttgggtttgttgaagctgaaaaggagtaatagcgttaaccacttacatcaccttactttccgatttctaaagccttcaaaagcatgcctttggaggcgtttaatgcagttacgtttgcttcatatgatctcgtgctgctgacaagatccaccatttcttttaatgggtctacatttggtttttgtacatatccgtctttattcgcgtcaggattctccggatcataaacgagattaaaagcggacgggtcttccgtaacgccagatacctttacgccatttcccgcgcttcctgttccgttcatcttggaatgtaaaagggacgaaaatgattcgcctccggattggagagataccagctttcttctgtaaggcacccattcgccatttacctgcttcgctctcgttgtatccatattggccaggttggacgatacgacgtccatccggacacgctgtgcagttaaagcggagcccgaaatatttaagctttgaaagccactcattattttcctcctgtcaagacggttttcagagaattgaatttgccgctcattctttcaaccaaagcctgataattaatttggttttcggctaaatctgtcatttctttgtcgatatcgacattgtttccgttttgctggtacgatgtatcactgctggacacgatagaataatcgtcccctgaacccgtaaagtcaacgtgccgatagtcggtttttaccgcttcaagattggatgtttcctgatctaacaaatttcggaaagagactttttttgccttatagttcggtgtatctatattggcgatgttattagttaagactttttgcttaatgtccgctctccccaaggcattctcaagattttgtatagttccagaaaataagtccaaatccacttacctccatttcagatatttttctcctaaaaatccttgtcgagaattgtaaaaccatatgcttattgtaagaaataacaggcttaaagtctatgaagttaggctaaaaaaaagtgctcaattatatctattttgcatgtaggtattaagtcctagagtatttggactacaagcatttgtttaatataagactgaaaatagcagaatttctgtatcttcctccttttttcacacagcaagatggattatctcagatcagcttccaataagcaactttaaactgcaacttttcacctattgtccataaaaaaagcaggacccccattttcagggatcctgcttttgtcttaatgagatttaaggttttccaattcaataaggaatttgttgttcagaactttaatgtacgtccccttcattcccaatgatctggattcaatgacgcctgcgctttccagctttctcagcgcgttaacgattactgaacgcgtaatgccgacacggtccgcaatcttacttgccacaagcaagccttcatttccgtcaagctcttcaaagatatgctcaatcgcttcaagttcactgtaagacagagaactgatcgccatttgaacaaccgctttgcttcgcgcctcttcttcgatttcttccgctttttctcttaaaatctccattcctacaacggttgctccgtattcagcaagaatgagatcatcatcttcaaattgatcctgcagacgggacagaatcagcgtgcccagtctctctcctccgccgatgatcggcacgatcgttgttaagcccgcttggaacaggtctctgttttccacaggaaacgccgtgtattcgctgttgatatcaaggtttgaagacgtctccggaacattgaacagatttctcgtgtactcttccgggaactggcggtcttcaagcatttttttcatgcggtcattttcaatctgctgattaatagagtagcccaaaagctttcctctgcggctgacgacgaaaatattagaatcaatgacgtcacgaagcgtttcagccatttctttaaagtttacgggtttgcctgccgcagcctgcagcatgctgttaataattcgtgttttttgtagtaaagccatgataaataatcctcctagaattcctcttattaaattttcacaatataaattgacttagatctttgttgtttgcaatcgttccgagcttttcttcaacatattgcggcgtgatggcgactttttccatcgtcacgtccggcgcttcaaacgacaggtcttccaagagacgttccaatatcgtgtgaagccttctcgctccgatgttgtccgtatcctgattcacatgataagccacttcggcgatcttacgaatagcttcgtcagaaaattcaagagatataccttctgtctgcaataaagcctgatattgttttaacagcgcgttatcgggttcgacgagaatcttcacaaaatcatccaccgtcagcttgctcaattctacacgaatcggaaagcggccctgcagctccggaatcagatcagacggtttggccatatggaatgccccggctgcgataaacagcacgtgatctgttttgacggagccgtatttcgtgacgacggtagatccttcgacaatcggaaggatatctctttgaacgccttctctcgatacatctgctgaggaagaagcccctccgttttttgcgattttatctatttcgtcaataaagataatgccgccctcttcagctcttaacacggcctcttggccgacttcatccatatcgattaatttgcctgcctcttcattggtcagaaccttccttgcttctctgatcgtcattttgcggcgttttttcttttttggcatcagattgctcagcgcatcctgcatattcatgcccatctgctccatcccggagccttgcagcatgtcaaacatcgacggctgctgctcttccacctctacggagacgtaatggtcttcgagctctcccaatgcgagctgatgcgccatgcgttttcttttttcttcaaggcttgcttcttcctgctgatcggcttcatcatcatttgccgtctgacttcctccgaaaagcatttcaaacggatttttcacacccgcttgttttttctttcccggaacgagaagccgcacgatacgtttgtttgcattttcttcagcctgttctttcacttcgctgattttttcttctttaatgagccgcacggatgtctcaacgaggtctctgaccattgattcgacatctctgcctacatagccgacttctgtaaattttgtcgcttcaatttttataaatggcgcaccggtaagcttggcgatccgtctggcgatctctgttttccccaccccggtcgggcccatcatcaggatgtttttgggaacgatctcgtctctcagtttttcatcaagaagacttctgcgatagcggtttcttaatgccacggcgacagcttttttcgcatcctgctgtcctacaatgtattgatccaaccgatctacgatttgtctcggtgttaacggtttgttttccatgcgcctcaagtcctttctattcaagttcttccaaaatgatctgatcgtttgtgtacacacaaatctcgcctgcgattttcaaagcggcttttgcaatatctttggcggacagattctctccggcataggttttcagcgctcttcctgctgaaagggcgtagtttccgccggagccgattgccaaaatgccgtcatccggctcaatcacttcacctgttcccgatacgagaagcaaggtatcctggttcatgacaatcagcatggcttccagcttgcgcagcactttatcgctgcgccattctttcgcaagctcaaccgacgcacgttttaaattgccgttgtattcttcaagcttcgcctcaaacatttcaaaaagtgtgaaagcgtctgcaacagatcccgcaaatccggccagaacctttccgttaaacagctttctcacttttctcgcggtatgtttcatgactacagcctgaccgaatgtgacctggccgtctcctgacatagcgcttttcccgttatgctggacggcaaaaatcgttgtcgcatgaaaagatgacatgagaagggcctccttttaattttctttaaaagctctcgggtggtgggacatatatgtgtttctcagcatttccttcgatacatgcgtgtatatctgcgtagaagacagattggaatggcccaaaagctcctggacgcttcttaaatcagccccttcattcagcagatgagtcgcaaacgtgtgccgaagcatatgcgggtgtatatgtaaagtgccggatgctttttttacaagcccgcttaaaatataccggattcctctggcggtcagcgggccgcctctttgattgacaaacagcacatcatgaggctcttttgctttttcaagcaggcactgccttccgctgttgatatacagctccagcgcatcacgggcatatgagccgaacgggatatagcgctgcttcttgcctttcccgtgaacgagcaccgtatccatgaacaggtcaagatcgccgacagtgagcgtacagcactcactgaccctcattccggtcgcataaagaagctcaagcagggcctgatcgcgcatccctgacggctgacttctgtctgagacagcgaatagttcctcaagttctttttcataaagaaacttcggaatccgtttctcttgtttcggcagatgaacaagctgaaacggattctcttcaacaagcttttccctcattaaaaatttatagaagcttctcaaagctgaaattttcttgctgattgtttttcttgacaggcctttttcataagcctctgtcaaaaatattctcacatcatgatatgcagcttctttcattccatttatattttgagcatgcagaaacatcccaaattcttcaatcgaattaacataattcacaatagtatattgtgaataatttttttcaatttgtaaatattcaacgaataactttaaaaaaaagttaacattctcagtcattatgaagacctccctctccgaagggcttttaaatggtatcatataatgcatcgaagttgcaatgaaaagctatatcgttttcgaaatagtttgaatagtctcaattgcgcgtttagcgtattcttcatttcgttcttttttgtttttaatttttacaggcaattcttttaagaggccgaagtttgcattcatcggctggaagttcttctgatttgtcgtcgtaatgtagtgagccatgcttccgatcgccgtctcctgcgggaatgtcacaagatcctgaccgagcacaagtttggcggcattgattcccgctacaagacctgaagcggcagattcaacataaccctctacaccggtcatttggcccgcgaaaaacagatcgttccgctgtttaaattgatatgtcgagttcaaaaggctcggcgagttgataaatgtgtttctgtgcatgacgccgtatctgacgatatcaacattttcaaggccggggatcagtttcagcacttctttttggtctccccattttaaatgtgtctgaaaacctacaatattataaagcgttcccgccgcgtcatcctgtctgagctgaacgactgcataagggcgcttgcctgttttcggatcttccagtccgaccggtttcatcggtccgaacagcatcgttttcttgcctcttttcgccatgacttcaatcggcatgcagccttcaaagaagatttctttctcgaattcttttaaaggaaccgtctcagccgtcgtcaatgcttcatagaaacggtcaaactcttcctctgtcatcgggcagtttaagtatgccgcttctcccttgtcataacgggattttaagtacactttatccatatcaaggctgtctttttcgacaatcggcgccgccgcgtcataaaaatacagatactcttctcccgtgagctctttcagctgctgtgaaagcgattctgatgtaagcggtccggtcgcgataaccgtcgggccttccggaatctctgttacttcctcagtaagaaccgttacgttcggatggtttttcacgagatccgtcacgctttgcgcaaattcatggcggtcaacggcaagcgctccccctgccggaaccgagcatttatcagcagattgaatgattgctgagtcaagcgcccgcatttcttcttttaatacgcctaccgcattggcgagtgtatttgaacggagggagttgctgcataccagttcagcgaatttatcggtatgatgggctgccgtctgcctgacgggccgcatttcgtatagttttacttgaattcctcgttttgcaagctgccatgccgcttcacttccggcaaggcctgctccgattacattaactgtttgctggttcatttcttttcatctcctgttgtttgtcccttccacacaaagaaggtgagcaaggctctgctcaccgctacttctgtggttcttccttataatcgcattcgacgcattggacttgtatgccttttttaagctttttctctacgagcatattttcacatttcgggcattttcgttcaatcggtttgtcccaagatacgaagtcgcattcaggataacggtcacagccgtaaaagacgcgtttcttttttgattttcgttcgacaatatttccttcatggcacttaggacattttacgccgatttgtttaacaatcggttttgtattccggcagtcagggaagttggaacacgccataaatttaccgtatcggcccattttataaaccatccgggagccgcataattcacaatcttcatctgcgtattcaggttcaatttccacttctttcatttcagcttccgcttttttcacgcgtttttcgaaatcggtatagaagctgtcaatgatttgaacccattctgtctcgccatcttcaacatggtcaaggtccctttccattttagccgtgaattcaacgttgatgatttccgggaaaaactccatgataagatccagcacgatctgcccaagctcagtcggcacaaaccgtttattgtctaatcccacgtaaccgcggcgctggatggtgtcaagagttggcgcatatgtcgaaggacggccgatccccagttcttcaagcgttttaaccaggcgcgcctctgtgtaacgcggaggcggctgagtaaagtgctgctcaggctcaatatcttttgataaaaccatgtctccctctttaaggtccggaagcatgcggtctttttcttccagctgatcgtctttaccctctacatagactttcatgaagccggcgaatttgactttacttccgtttgcccggaatgtcaatccgttattgctgagatcgacgctcatcgtatcaagtacggcaggcgccatctggcttgcaacaaaacgctcccaaatcagcttgtatagtctgagctggtctcttccaagcaccgcttttaagtcggcaggttttctgagcaccgaagtcgggcggatcgcttcgtgggcatcttgagcgttttcatttttctttgccggtttccgttttcccgctaagtactcttttccgtatgcctgatcaataaaagctgacgcctcttcaacggctgtattggaaattcgcgttgagtccgttctcatatacgtgatgagtccgactgtcccttctttgccgagatcaattccttcatataattgctgagcgatcatcatcgttttcttcgctctgaaattcagcttcctggcagcctcctgctgcagagtggacgttgtaaacggcagagcgggatttcgtttgcgctcttttttcgtcaccttgtcaactgtatacttattgcctttcagctgagcaaggacggcttttacgtcttcttcgctttttaaaggaagctttttgccgtttttcccgaaaaatccggcttcaaacgtctcttttccctttaaaaatgagccggtaatcgtccagtactcttcaggtttaaagtcattgatttccttttcccggtcgatgatcagccggagcgcaacggattgcacacggcccgcactgaggcctttttttacttttttccaaagaatcgggctgattttgtatccgacgagtctgtctagtatgcggcgcgcctgctgcgcatcgacaagatccatgttaatcatgcgcggatgtttaaatgattctttaatggcgtctttcgttatttcattaaagacgacccggcagtcagagctgagatccagatcaaggctgtgtgcgagatgccatgcaatcgcttccccttctctgtcggggtcggccgcgagatagactttttttgctttctttgccgctgtttttaattcttttaaaacagggccttttccgcggatcgtaatatatttcggttcaaagttctgttcgatgtcaactcccatttgacttttcggaagatcccggacatgtcccattgaagctttgactttatatttcttccctaaataacgttcaatcgttttcgcctttgccggcgattccacgatgactagataatcagacattttcatccccctcaagaggtgttctctctcttttcaagtatcaattcattttagagctgcctttttatggctttcaacatttcattctttatgatgaacgtcattttatacatgaaaataatatgcaactttaaatcctcactattattaaatattacaataccgtttgtcaaacgatatttcaaaagggttccgtatactgaacgcatcgggcggtcagctctccgtcaatatcctctgcgcataatacagctttcgccccttcttgaatgagttttataggtcctccggaatatggattaaatatggaacccggaacggcaaatacctctctgccttgatcgagggcctggtaagctgtgattaatgaaccgcttttttcttttccctgcacgaccacaattccttcacttagtccgctgattatgcggtttctcatcggaaagtgccattttttcggctttgtttcaggaggatgttctgagagtaggagatggtgttcagccatgtattctgctaacaggagattttcccggggatagatgtgatggaatccgccggctatcacgccgatcgtaagcccttttgccctgatgctcgccttatgagacaaaccgtctataccggatgcaagcccgcttacaatgacccagcctttttttgagagttcggcggaaagatgcccagccgcttttattccgtcttccgtcggtttccgcgttcctacaatcccgatttttctgcctttttcaagaagcggcgtgttcccttttgcatacaagacagccggcggatcataaatcgctttaagccatgttgggtaacggcttgatgaaatcggaatgacagtaatgccttcgcggcggtaatcggacagaacttcatcaagttccggatccttgcgctctatttcccgaaaaattgcttccggggctgttttcccctctgataaaacagttaatggatgcggatccgaaaaaaaagacagagagtgatcagctttccaccattttaatagaagagacggggaaatgatttgattaatactgcagaccattaaacagcgcgatgcttgatccaaatctggcaacctcctcttttttcagcaaaaacaggaacagccgttacggctgcccctgcttcgatcagtgcgttttgcacgtttcaaataagcctttttcttttaacaccttaatcagcgtttcacccattacagaaggggtttccgcgacttcaattccgcaggcgttcatcgttttgactttttcttctgccgtgccttttcctccggagatgatggcgcccgcatggcccatgcgttttcccggaggcgcggttttaccgccgataaagccgacaacaggcttcgtcatgttcgctttcacccactcagccgcttcttcttcagctgtgccgccgatttctccgatcatgatgacggcatgtgtttcaggatcttcattgaacgcttttaacacgtcaataaagttcgtgccgttgaccggatcgccgccgatccctacagcggtagactggcctacgccggcttctgaaagctgatggacggcctcgtatgtcaatgttcctgaacgggatacaacgcctacatgaccctttttatgaatgtatcccggcataatgccgatcttacattcttcaggtgtaataacacccgggcagttcggccctattaatctcgttttcttgccttccataaagcgcttcactttcaccatgtccaaaaccggaatgtgctcagtgatacaaatgacaagatcaatttccgcgtcaaccgcttccataattgcgtccgccgcaaacggagccggcacgtaaatgactgacgcatcagcgcccgttgtgtgaaccgcttctgcgaccgtattgaataccggtacgccttccgcttccgttccgccttttccaggtgttacaccgccaacgatattcgtgccgtattccagcatctgctttgtatgaaataaagcggtagaacctgtaatcccctgtacaataactcttgtatctttattgataaaaacactcattatctggtcccctgcctttcattctttcctaaactaaggatacgattttctgtgcgccgtctgccattgattccgcagatgtgatgtttaagcctgattcattcaggattttctttcctaaatctacgtttgtcccttcaaggcgcacgaccagcggcaatgtcaatccgacttgtctcgtcgcttcaacaacgccctcggcgatgacatcacacttcatgatgcctccgaaaatattaacgaaaattccttttacgttttgatcggaaagaatgattttaaaagcttccgtcactttttctgcggttgcgccgcccccgacatcaaggaagtttgcaggttctccgccgtagtgtttaatgatatccattgtagacattgcaagacccgcgccgtttaccatacagccgatatttccatcaagggaaatgtagcttaaatcgtattttgacgcttcgatttctttcggatcttcttcatctaaatctctgtattccataatgtctttttgtctgtataacgcattgctgtcgaagttcagcttagcatccagcgccatgacgtttccgtcccccgtaacgacgagagggttgatctcggcgatggagcagtccttctcaacaaatgctttatataaaccgagcataaatttagcggctttgccgacaagctctttcgggatgttaattgcgaatgcaatttcccttgcctgatagccctgaaggccgacagccggatcaattaccgcttttttaattttttcaggtgttttttccgctacttcttcaatctccgttccgccttcttcagacgccattaaaacgattcttgaagtagcgcggtcaagtacaagcccgacatagtattcctttttaatatcgcagccttcttcaataagtaagcgttttattacttgtccgtccggacccgtttgatgtgtgacgagcgtcttgcctaacagttcttcggcatactctttcacttcatcttttgtttttgcaatctttaccccaccagctttgccgcggccgccagcatggatttgcgcctttacgacataaaccgagcttgacaggctctctgctttttcaactgcttcctctgctgtaaaagccactttaccttcaggaacagacaccccgtattttctgaggacttcttttccctggtactcatggatattcatttcccatcctcctaacttatgtagcaaaactaaaaatagactgcgctttcattctatataatactggaagaattgtctagggttcaaaacaaaatctttatatccttccaaacattctaacttttattttattgaaaatataaatttaaacggagtccgggaaatgaatggtccttatttttcgtttttcagggtttcgtccagtctgtaaacaaatgaaaaaatttcggcaacggtttcataaagcgcctccggtatgtgatcgtcaaccgtcaaatggcgcattaattcgacaagggttctgtcttcctgaatggggaccccagccttctcagcttcttttataatattttccgccacatgccccctgcctgttgcgacaactttcggggcttgatctttctgccggtcgtaatgcagggcgacagctcttcttaacggcgtttgctctttcatattttcacatccacttttcttccgccgtctttttctataaactcttccacaagagcgctctggtctttcgggcgccgttttttagacgtgacgcctgacaggctgaagcccgtttcttttacggcttcttttaaagccggtacgagagggtcgatggccgcctgaagctcaaaatcagtctcaaccgtaatggtcattacattttgctgaatcatgcagtccacaacggtttcttgcagtgtttcaagatgcagcaaaaacaggagcctgcaatgtgacggatcgagttttccgtccggcttcttccgtcctttaaagagaactgtgatgtcattctcatacgcggacgctcccagcggaaatgacagcaccatctgcgtaaaagaagggttatgctgctcaataaacagctggccgtttaatttatgaataagcggttccgcctcttgtttaacggattggggcgcttcttgaagcgtccggacggcttggagggccgttttcagcgcttgtttctccggctgcggagatacgcctttttcaagcgctgtaatgaatgataattcatcacgcgtgcccaatccttttttgattttctgcaaaaggcttaatacatcatctttttccgcatatttcaattcggtgagctgaacggctttttcgaaaacagccgcctcctgttctgtcagatgtgctttttgaagaacaggtgctgttttaaatgttttttcttgagaaatgaaagccttaatgatctccgccgttacttttacggggcggttttcagttttttctgccgatgtcattaatttctctataatctgttttgccgttttttcaggaagtttttgatctgtccgcgcactcggaggagaaggttggcttgagactgcctttccgttttcacgagtctctcggacaaatggtgattgttttgattccgtccgttcttcttcatccatcagcccggtttctgggatcggcatgcgtgcagcctcggcaagcttcttcaagagacgttctgcatgaagatccgtttccgcgtttaatacgtcagaaaccgcctctttgagcacagacagctcttttgccgattgcggtgcctgattgattgcctgaagcagtcctgagaggaggcgccgggtcggaaccggatatttaacggcatgaatggctgacaagacttccggatgtgcgggcagttcccgtttcagcgcaaatacgattgtttccgccgcttttttcaattcggcggccggaagcgattcagcccagcggacgcaggctttgaggctgttttccgtcatcggcagcttctgctgcataaacgtttcggcaatctgcagagacacagggcccggtttgacggaaagagcgtttaacagtctacccgccgcttcctgaacggttttcgggcttccttcgaattggtcgatgacatgaagccggcccgttttttccgccggctgtttgtcataagaaaaccagtaatacgcctgcggacgaagggcggtttcaagttttccctgcatcgtccggccgccgatctggataagagcgctttgatcgtccagcaaacggagaaccttccctaacagcagcctttgagtaccgctgtctttaccgccgtcctgccggtccggagggatttccgccgtcagctgtctgaaagccgcttggatttcgccgctaatgttcatgtcttaagcctcttttctaacaataagattgaacgggagcgaacgtttttcggtgaatagttgtcggtccgtatgcctgaagagcttcaagatgttctttcgttccgtagcctttatttttttcaaagccgtacatggggtaagttttggcgtactcagccatgagacggtcccgcgttacttttgctatgcaggctccggcggcaattgacacgcttttggcatccccttttataactgatgactgcggaatgtcaagcggaagggtcatggcatcaacaagcagataatcaggtgtttccgttaaagcattgacggcttttaccatcgccagtctcgcggcctcataaatgttgatccggtcaatgacgtccgcatggacaatgccgactcctacagccgccgcttcttccgtgatccggctgtaatactcctcgagcttcttttccgacaatttcttcgagtccgtgagaccgagaatctcgcattctgccggcaaaatgacggcgccggcgacaaccggtccggcaagcggccctcttccggcttcgtcaacacccgcaatcaggcggaagccctttttggatgacagtctttcgtatgccgtcatgtccagccattgctctttaagagctttttccttcgcatgctttttcagccattgctctaaaagcgtctgtacgctttttctcgggtctttctcacattgggcaaggaaggggtcgctttcgtccctgatctcttgcaggcgttcttttacgctttttacggttaatgtattcacgttctcttctcccttacattatgtatatcggtattctgcggaaaaaataaagacccgcatcgctgcgcgtctttattctgatggtgcttcaaatgaaagcctgccgaatttttccgtccggatgtcccgaatgataacttccgttgttttatcatagtcaaccattccgccgcccatcaaacagccgcgtttttcaccgatcgcgtcgaaaagagcggcgatatcctcagggatttcctgaagtccgtagcgctccttcaaacggtcgggataatgctcttccagaaagcgcagcccgaaaacagccacatcctgcaggttgataatcgtatctttaatcgccccggtgatcgccaggcgcaagccgacaagctcatcttcaaatttaggccataaaattcccggtgtatcgagcagctctaattccttgcctacctttacccactgctgtgaagtggtaatgccgggcctgtctcccgtcttggcaatgttttttttggccagccggttaatgagcgtagacttgccgacattcggaatgccgatgattaatgcgcggattgctctcggcctaacaccttttgctttcattttatcgaacttatccttcagcagctctttcgaggacggcacgatttgatgcagtccctgcccgttaacggagtttattgaaagagagggaatgccctgttcctgaaagtggtccttccactgggcagtcacagccgcatccgccttatcggctttatttaaaagcataatgcgcggcttattttttaaaatctcctcaatcatcggatttctcgatgacatcgggattctcgcatccaccaattcgtatacgatatcaattaatttcagtttttctgttacttcccgtctcgctttagccatatggcccgggaaccattgaatggtcatgtgacttcgacacctgccttatttaccggaaccggatgttccgatgatctcttatgtattttacgttgcttgttccgcttttacaaatttcatataaaaaaagagcctgttacgggtaacaagctcttttcgttcgttatcattatcgtctgatttctttaatacgagccgcttttccgcgaagttcacgcaggtagtaaagcttagcgcgacgtactttaccgtaacgtacaacttcgattttcgcgatttttggtgtgtgtacagggaatgtacgttcaacgccaacaccgtaagaaatcttacgaactgtgaacgtttcgctgattccaccaccacgacgcttgatcacaacaccttcgaagatctggatacgctcacggttaccctcaacaacttttacgtgtacacgtaaagtgtcaccaggacggaacgcaggaagatcagtgcgaagctgttcttttgtgatatcttgaattagtttttgcatcgttttcaactccttccaacagatgctcttggccacaactgcaaggcacagcggaacatcgttttcaagcttctgaaggataagcctccttaagccacaagtagtatcttatcatatcttcatcacctgcgcaatagaatctattcgttttcccactcggaaatccattttctttgctcatcagtgagaggatagttttcaagaagatccggacgtcttaaaaaggttcttctgattgattctttattgcgccattcttgtattttggcatggttgccggacagaagggtctcaggcacttttaagcctttataatcggctggcctcgtatagtgaggatgctctaaaagccccgtgctgaaggaatcctccacgtgggatgcttcttttccgaggacgcccggcaaaagcctgacaacgctgtcggcaatcatcatggcagggagctctcccccggtcagcacaaaatccccgatggagatttcatcagtgacaagatgttcccggatccgttcatcatacccttcataatgcccgcaaataaacatgagatgttcctcttccgccagctcctcggctttcttctgcgtataacgctcaccttgcgggcagacgagaataatgcgcggcttggcgtccgtaccggctgtcagcttttcaaccgcatcaaatacgggctgcggctttaacaccatcccggctcccccgccgtacgggtaatcatcaaccgtttggtgtttattatccgaaaaagcccggaaattgatgacgtcaaaacggacagcctctttttcctgtgctttttgcagaatggatgaaccgagcaccccttgaaacatttcgggaaacagtgttaaaaagtcgattttcattcgtctattaacccttccattacatgaatcttaattttcttctcatttatattaatatccttcactacagaagctatatacggaatgagcgcatcttttttgccttttcttgcaaccacccatacgtcattagccccgggcgtcaagatttccttcactgtgccgatcagttccccgtcttctgacacaacctcgcagccgatgatttcatgaaaataaaattcatcttcttcaagctctcccaagtcttcttcaggaactttgatcaccatgtttcttaggtgttcgacttcattgagactcggcatttctttgaattgcagcaggtgaaactgcttgtgaagcctgtgggcgctgaccgttactttgattggctccgcagccccctccgcaaacaaatagagcgtattgccgggcttgtaccgttcttcggcaaagtccgttttagaaatgacccgcacttcgcctttaatgccgtgggtatttacaattttgcctacattaaaccatctgtttgtcatattatcacctcgggcggatttcaattactaccccgtcttttatgacgatggtatttgccgctgttttttcatgccagttatcaccgacgttgattgaaagcagcgcatcgatctccttttccttcacttcgcttccaagcgggagcgactctgtctggcttatttggaaatcgatcattttgattttatcttgtcttttttcaatggcttttttaaaagattccgctacatcgggattctgctgatctttttcatgttttctaagctgaaaatagagctggctgcattctcgttcaagcgtttgctttttttctgcaaaagaggccaaaagcttttccttgctttgctcggtcagaacctgcataacggttaccctgtgaataatctgcataggaccagactccccactcttccaacatatttctgttcatttgccttttttacgtgtaaaaaaaggggaggtgccggccctctccctttttcagtcaaatatttcaaattgaactttcttagaagactgtgcgccagctgcaaaaacgacggttcgaatcgctcttgcagtccggccttgctttccgataatcttaccggtatccgacttattgacagataagcgcagcgcaatcttttgatcagtctcttcctttgtgaccgttatgtcttccggatggtcgacaagcggagccacaatgctgacaatcaaatcttccaagttctgatcagtcattacttgccttgtttagcgttgtggaatttttccataattccttggcttgagaacaagttgcggactgtatcagaaggtttagctcctgtttgaagccatttaagagcaagctcttcattgattttcacttcagccggctttgcaaccgggttgtatgtgccgactgtttcgatgaaacggccgtcacgcggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtaatttaaagccttttttcttcccttttgacatgttggtcatctgcttcatcatttttttcatttcctcaaactgctttaaaagacggttgacttcctgaacggatgttccgcttcctttggcaatccgcttccgccggctggcgttaataatatccggctgttctttttcaagaacagtcattgatttaatgatcgcttccacatgattcagctgtttttcatcgacttggatgttttttaagcctttcattttgcctgcgccgggcatcatttgcagcagttcgtcaagaggccccatgtttcggacctggccgagctgctccagaaaatcatccaatgtgaagctcatcgttctcattttctgctcaagctctttggctttgtcttcatcaacggtcgcctgagctttttcaatcagcgtcagcacgtcacccattccgagaatccgggatgccatccgttcaggatggaacgcttcaagagcatcgagcttttctcccattccggcgaatttaatcggcgtttcggtgaccgcgcggatagaaagcgccgcacctccgcgggtatccccgtcaagctttgttaaaatgacgcccgttaaaccgagctggtcattaaagcttttggcgacgtttaccgcatcctgaccggtcattgagtcgacgacaaggaaaatttcctcaggatttgcgacttcctttacgccggagagctcatccatcagttcatgatcgatgtgcagccgtccggcggtatctaaaatcacataatcatgatgctcttccttcgctttttcaatcgcctgtctggcaatttccaccgggctgacctgatcgccaagcgaaaagaccggcatatcaagctgtttccccagtgtttccagctgtttaatcgcggcggggcggtaaatatccgcagccacgagcagcggtttgcggttatgttttttgcgcagcaggttggcaagcttccccgtggttgtcgttttaccggcaccttggagcccgaccatcataataacggtcggcgggcgtttggcggcggcaattttgctttcttcgccgcccatcagctcggtaagctcttcttttacgactttaataacctgctgaccgggtgtcagactctgcatgacgtcctgcccgacagcccgttcacttacttttttcacaaaatcctttacgactttaaagttaacgtcagcctcaagaagcgcaagacggacttcacgcatcatctcttttacgtcttgttcgctgacttttccttttccgcggatttttgaaatcgtcttttgcagtcggtcggctaatccttcaaatgccattgtttgccgcctcctaatctaatttctcaagcgcttcaatcagagccgtcattttttcctcttcctgcaagccggaagcaagctctttcagctttgtaaacatttctttacgctcctgaaactttttaaaaaggagcagtttttcttcatattgttcaagcatcgcttcagtccgtttgatgttatcgtaaacggcttgccttgaaacgtcatactcttcggctatttcaccaagggagaaatcgtccagataataaagcgacatatagctcttttgttttgacgtcagcaacgactgatagaagtcaaacaaatagttcattctcgtcgttttttcgagcgacatttgagctctcccctttgttaagtcaaatccctttacaaaaacttagtttacatggtttcagagcgtgtgtcaagtttttatcttgtcaaagcaggatgctctttttacataataagtgttttcaaaaaaattcatacagaccgtcgttaaaatactcgaattcttgttttgatacacgatagcggcaatagccttcgtaaaaagcattgagacatgattcatttgtgacaaaacgactgatcgctaatgattcatcataacgcggatctcccgccgatattcccgcagcatcgataaacagatagacctctccgtctctcaccagcacattatcagtcgtgcagtcaccgtgaatcattgtctgctgaacaggaacaggcctgtacctgtccaattccttcaatagctctgcacttccttcagcttgtccttttttgacatattccccggctcgtttgatttgcagatcgagccagtctgtttccggctgtaaaccagagaccatttcggtttcatgcagccgctgcagaaactggccgaaacttttgatcagctttttcttttcagtatcccctttggcttttcttaaagccgaagtcagggtgattccatcctcaaatgacatgatgatatggctggcatgctgttcctgtatcatcccatagtaaataggaacaggcagacgacgagtttccgtcagttgttgtaaaacgaaggcttctctcattaaccattcccgatacttctgttgaaaagaacttttcagcaaaaatgcgtcttgaccggtcactatttttcgaacggttgaagtgcctccctgttcatccagcagcgacatatggtttatcgcgccgatcttactttccaattcagctttcagccatttgtccaacaactgccccctccattccgatctatcaatgcgtataaaaaaacgagtataaaaccgtccattttatactcgttttttattcattaatcttcggctttttcaactaaatccgaaaagagaccgtatacgtaagattctgcatcaaaccgctggagatcgtcaaccttttctccgaggccgaccagtttcacagggatgtgaagctcattgcggatcgccaggacgataccgccttttgcggtgccgtcaagcttcgttaatgcgatacccgtcacattcgtcgctttggagaattctttcgcctgcgccatcgcattctggcctgtcgtcgcgtccagcgcaaggagaacctcatgcggggcctcaggcacttcgcgttcaatgacgcgtttgaccttttcaagctctttcattaagttaactttattctgaaggcggccggccgtatcacaaatcagcacatccgctcctcttgctttagccgcgtgtacggcatcataaataaccgccgcagggtcgcttccggcagcctgcttaatgacaggcacgcctgtacgctccccccacacttcaagctgttcaatcgccccggctctgaaagtgtctccggcagcgagcacaacggatttgccttcattcttcagcttatgggcaagttttccgatcgttgtcgtttttccgacgccgtttaccccgacaagcagaataacgttcaggcgcccgtcctgaatatttaattcagaaatctgttcgtcgccgctgttataaatgtcgacaagcttttcagaaatgacggactgcacttcctgaggatcctgaatgtttttcagcttcacttcttttttgagctcatcaatcagctccatgacggttgtaaaacctacgtcagcgccaatcagcacttcctcaagctcctcgaagaaatcctcgtcgactttccggtagcgggagacgagttcgttcactttatttgagaaggaatttcttgttttttcaagaccatctttaaatttttcagagacggagtctgtctgtttcgtgattttctcttttaattttttaaaaaagctcatctttcaacctctttcctcgttactgaacgaattcttttgtttcttccagtttgaccgaaaccattcgggaaacgccggattcctgcatcgtaacaccgtagaggacatccgcttcttccatggtgccttttctgtgggtgatgacgataaactggctgtcgccgctgtatttttttaaatattgcgcaaacctgaatacattggcttcatcaagcgcagcttccacttcatcaaggacgcagaacggcacgggccttactttcagaatagagaataaaagggcaatggcagtcagcgcccgttctccccctgacaaaagatttaagttttgcagttttttgcccggaggctgcgcgataatgtccaccccggaattaagaagatcattcggatcagtcagcttcagttcagcccgtcctcctccgaataaagaacggaacacgtcgttgaattgagaacggatctggataaacgtttcatggaatcgcttcgtcatttcagaatccatttcttcaatgacttgaaacagtgtgtttttcgcttccgtcaggtcatttttctgctctgttaaaaactgataccgttcgtttactctttcaaactcatcgatgctgccgagattgaccgttccgagctcttcaattgaaagcttgatcagtttgacccgttttctcgcctcttcaggctcgagttcaagctgatattgttcttttgccccttcaaaggataagctgtactcctcgcgtaaatactgcaagagattatcaagctcaacttccatccggccgagttttacctcttcatctttcagaatgtccgttttttgcttgtacagacgcttcatctctttcaattcaagctcgttcgtatcaagcgcccgctggagcttcacacgctggtcgcgccggctggcgatcaattcgatcgttctcgttttatcgtgaagcttatgatgggctgcttcttcaagctgctcctctccgcttgtgctggacgtcatctctgaggtcaggaggcttaaatcttcccgtgtttctttcagagcgagctgcgtttcttcaagctcttttttcagccttttgaggttgtcttcctcactcgagcacgcctgttcttttttcgcagcggccactttacattccgtcagttcatgagagagcgtttcttttgttgaggatagggtctgcttttgttttgtcagcctttccatctcttcctcaagctctttcagctggccggatgcctcactcagctgttcttccagagctgatttgcgcgtctctttttcccggctgctttccgtcagtgatgctttctcctggtcgtaaagctccagatgggtattgatgttcttttcagcaacttcgagttcatacagcctgccttttacatcctgctgctttgttctgaaagcctcaccgtcttcacggagaccgctcagcgtatgttcaagctcttgaatggcctgcttcagcgctttgacctctttttcgagcagagctgttttttcttccatttcggcaagccgcgcagtcaccgtctcaagctcgcggcttctgccgagcagagaattgtttttctttttgaccgcgccgcctgtcattgatccgcctggattgacgacatcgccctcaagcgtgacgatgcggtagcggtgcccgagaagcttggccagttcattcgcgccttttaaatcttcagtgatcagcacggtgccgagaaggttttgaatgacattccgatacgccgcatcatatgtgacaagcccgctcgctgtgccgaggaaagacggatgctttgaagccgtctgttcatcacgggtttgaagctggcgcggtttcataactgtaagcggcaggaacgtcgcgcggccgaaggaattctgttttaaatattgaatcgctttccgcgccgcctgctcatcgtctgtgacaacgtgctgcgccgctgcgccgagtgcaatctcaatcgccgtttcatatttttgttcggtcgcaatcagttcgagaacggcgccgcggatgccgccgagctgctctttctgcttcagcacttcttttacgccttggtaaaatcctgaaaaatcgccttgcatcgtttcaagcatatcttttttggatctggcctgctggacgaattgatatgcctgatacagcgctgattctttcttttcatactggcgttttttctgttcatatgctgtctggacttcgcgaaagcggacgacctgattgtgaatatcctcttcaacggcggccaattcctcttcgcacgccgctttgcggactgcaatatcgttacgttcttcaaggtatttttcattgtttgcggtcagtctcgcctgctggaccgcagattgggacatctgatcatctaaaagctgcagctcgttgcgaatcgacgcctggctgtttaacaattcaaagtaatcgctttttaattgttcgattttctcttctacattttcattatgcagactgagagcctgctgcttttctttcacctgggcgtttaaccgcttcacttccgcacgaagtttatcatagacggcagactgtttttcaatgtccgctttcagttcggcttctttgttcgtgtaatgtgtaacggattcctctagctgttcccggttttgcgcggcgttttttttgcgctctttcagcacttctttccggccttccagcttttccagctcttcacttgtcacgagcagcacctgctgcagttcgttgacggattcatcaagcgcgtggattttatctctcgtctcttctatcatcgcttcttttgcggacagagctgatgattccgccaattcttcttgttttgccgtctgcaccttttcttttaaacccgaccatctgctatgcagttgttcgatgtcaaaggcggtaagggcgatttcgacatgctcaagctctttctttttttctaagtagtctttggcgattgatgcctggattttcagcggttcgacctgatcttcaagctcgtggagaatatcttccaccctgtttaagttatcctgcgtctcaaacagtttgttttccgcttttttctttcgtgttttatatttcagcacgccggccgcttcttcaaaaatactgcggcggtcttccgctttgctgctgagaatctcttcgactttcccctggctgataatggagaacgcttcttttccgagcccggagtccataaataagtcaatgatgtctttcaggcggcactgctgattgttgatgagaaattcactttctccggaacggtacacccgcctcgtcacgctgacttcgtgataatcgatcgggagaaaatgatcttcattatcaagcgttaacgtgacttcggcaaggttcagccgcttgcgcgaatcacttcccgcaaaaatgatatcttccatttttccgccccgaagcgagcgggctgattgttcgccgagcacccagcggatggcttcggtaatgttgctctttccgctgccgttcggaccgacaacggccgtgacgccttttacaaagtcaacggatatccgttctgcaaatgatttaaatcctataacgtctaaacgtttgaggaacatcccagatcctccttatcgtataagtatctcaatattatcataatcacccgcttatatcaggcgcagacatactgaaatccccctagggatacagggggattttattgtttcgtatgatgtttttgcaattttgcaagagcttcctgtgccgcatgctgctcggcttcttttttggaacgtccgttcccgataccgagcgcctcacctttaagagagacgagcgcctcgaattcccggttgtgggcaggccctttttcattgagaattttgtactcaagcgatccttttccgtcccgctgtacaaattcttgaagctggcttttgaaatccatcacatgagaaaaagcaccatcgtttattttagggaacacgtactctttcaggaattgctgaaccggctcaaggccctgatccagatacagtgcgccgataaacgcttcaaacacatccgctaaaagcgcaggacgctttctgccgcccgtcatttcttctccttttcccaagagaacaagatcgccgaatgacaattcgtgggcaagtgagacgagtgacggctcgcatacgatagcggctctcagcttcgtcaaatctccttcactcatggccggatatttggcaaataagaattgggagatcgtcagttccaaaacagcgtcacctaaaaattcaagcctttcgttgtcttcatacggctttttccgatgctcattcacataagatgaatgtgtaaatgcttgatacaaaagtttctcgttttgaaaatgaaccgaaatccgttcttggaactctttaaattgctctatttttttatagaacttttttttatctttaaaatgtgagtgttttgacatagtaacctccataggcacatcaggttcaccgcgctccccgccgtaaacggaatcagcagcgcgtacagcgtcagacgccggtaaccgaacgattaaagggctaaagccccgctgtcaggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtcagcttcatcaacgccaaggcggtctacgatgattttcgttacacgctctaatgtatctgccatagcaattcacctcccctcaagtattatagaggattcgtttttaaaaaactagagaaactaggatgaaattttaaaaacaaatctttacatcaccattccgccgtcaatatgaagggtttggcccgtcatataacgcgatccttcagaagcaaggaacgtaacaacgctgctgatatcggaaggatcaccgaaacgcgcgagcggaatctgcttcagcatttcatcttggacttctttagaaagcttgtccgtcatatccgtggaaataaagcccggagcaatggcattgaccgtaatatttcggctcgcaagctctttggctgatgacttcgttaagccgattacaccggcttttgccgccacatagtttgcctggccggggtttccgctgacgccgacgattgatgatacgttgataatccggccggagcgctgtttcatcatctgtcttgtaacggctttcgtgcagttgaatacaccttttaagttaatgttaatgacatcatcccattcattttctttcattctcatcagaagattgtcttttgtgatccccgcattgttcacgagaatgtcgattgaagaaaatgcagcgacagcctctttcatcatgttttgtacttcttcggaatttgatacatcggcttttacggcgatcgcgtttcggcccaaagatttgatctcatctacgacttcgttcgctttcgcttcattcccggagtagttgactactacattacagccgtttttcgcaagatcaagcgcgatcgcccgaccgattccgcgggacgctcccgttaccactgctgttttttcattaagcatcctgattctcctccttcagcgtttgaatcgccagttcgatggtttcatggtcagaaaccgagattgttttaaggcggcggttcacttttttcacaaggcctgaaagcacttttccgggcccgatttcaacaaacgtcgtgacgccttcgtcaatcagtttgttaatggtttcttcaaagcgaacaggcgaatacagctgttcgatcagttttttcttgatatcgtctttttccgtcataacgtcagccgaaacgtttgaaatcacgggaacagccgcattttttaactcacaggcgctgagcacctcctcgagtttttgcgctgccggcttcattaattcagaatggaacggtccgcttacttctaatgggatcgcccgttttgctccgttgtttttcgcttcctctgaagccagctccacgccttttgccgttccggaaatgacgatctggccggggcagttcagatttgcaagctgtacgagatgaccgttttccgtcacttgatccgtcacctttttcaaggactccgcatccattccgagaatcgctgccatggcgccttctccggccggcacggcttcattcatgaattctccccgttttcttaccgtgtaaacggcatctttaaatgtcatcgctcccgccgcaacaagcgccgaatattctccgaggctgtggccggcggtgaaatcaggggtgatgccggattctttaaacttttccaatacggcgatgctcgttgtcaacagcgcaggctgcgcattgtatgtaagggtcaattcttcggcgtcaccttcaaaaatgagcgagctcagctttgtttcaagcgtttcatccgcttcatcaaaaatacgttttgacgcttcttcgcgttcgtacaggtcttttcccataccgatatattgtgatccctgtccgggaaataaaaatgcaatcttactcatgatgcggtaacctccagactactcatctgttttttcttcttttacttcttcttctataaatgcggccacgttttggctgaccatttctctcgcctggcgcagcgcatggtaaacagcgcgtgcgtcagaagagccgtgcgctttaatgacgggcgctttcaaaccgaaaagactcgccccgccgtactcagaatagtccattttcagtttcatttccatcagcttcggcttcagcactcccgctgcgagcttagaaacaaaacttgaagtcagtgtatctttcagcattttgaaaatcgataacgctgaaccttccaatgttttcaacgtgacgttgcccgtaaagccgtctgtgacgatgacgtcagcagcgccttcgagcaagtctctcgcctcaacgtttccgacaaaattcacgtttgtttcttttaataattcaaacgtcttttttgtcaggtcgtttcctttcttttcttccgtgccgacatttaacaatccgacgcggggcgagctgattccgaggacctgccgggcatatacagatcccataattccgtactggacgaggtgctccggtttggcatcgacattggcgcccacgtccaaaagaaggaaaccgtcgcctgaaacggtcggaagcgtcggcgcaagcgcaggccggtcgattcctttaattctgccgacgataaacagtcccgctgtcatgagtgcgcctgtattccccgctgagatgcaggcgtccgctctgttttcagccacttcctgcgccatcagcaccatagaagagtttttctttctgcgtacggcgcggaccggttcatccgtcggttcaatcacttcatcggcgtgcaacacagtgatgcggtctgatgttgttggcaagtgtgattctatcgttgtcttgtcaccgaccagcgtaatatgaagatcgtcaaatgcctcaatactcttcattactccgtcaataacagctttgggtgcgttgtcgcctcccattgcatctacagctattctcatgcatgctccacctttatgattgttttgaacggtacatatcaaaactgccggagaacacgacttcttctcccacatagctgttgacttcaactaccgttctgcctttttctttttcgactgccgtcactttggctttcgcaacgacgcgctcgccttctttcacctgtcttgtaaagcggatatttgcgcttgcggtcagcgccagctcatcatcaatgacggctacggcgagtgagttcgcctgcgcaaacaaatgatgcccccgcgcaatttgattgcggctgaagacatgttcgcgtcttacttctaatatggaaatggcctggccgtcaagctccagatcaatgatttcaccgatcacttcgtctaaagacaatgatttcacttcatcatcaagcgtttgttctgccacgtttttaattctttccctcagctccggtattgagagctctaagcggtctaaacggatcgtctgaatgctgacgccgaatttccccgctaattcttcatctgtgatgaagggtgtcgatttgatcgtctgctgcaataatttttggcgttctttcttgcttcttctcatctgtaaacaccatccggacaattaagactaggtactaatagtagtatataatctcatagattggaatgcaatgattgttttttgaaagccgccgaattttacagaatcagcttaatttctccccttctaagacgccgcttgaaagtaattgaccgcgcagcatgcggtattcgtcatctttccaaaaagcctctgaagacaccagattggccgcatcctggcgggccgtttccaaagctctgtagtcatgaaccatatccgccaccttgaactcgggcataccgctctgtttttttccgaagaaatcaccggggccgcgcagttcaaggtccttttcagacagctcgaagccgtcgtttgtctctgacatgattctcatccgttccttcccggtttcggatttcggatcggccatcaagatgcagaaagattggtggtctccccgcccgacccggccgcggagctgatggagctgagataatccgaaacggtcggcgtcatagatgaccataatcgtcgcattcggcacgttcaccccgacttctacgacggttgttgacacaagtacctgacattgattggcgctgaattctctcatcacttgatctttttcatcagaatggagcttcccgtgcatcaggccgacattccatttaccgcggtaaacgtcagacagcatgttatatacgtcaatcgcattctgtacatccagtttatccgactcttcaatgagcgggcagataatataggcttgccttccctgcttcagctctttttctataaaagccaaaatccgctccagcatgtcgtgtttcacccaatacgtttcgatttgttttcgccccgcgggcatttcatctatcacggaaacatccatttctccgaagacggtaatggccaacgttctcggaatcggagtggctgtcataaacagcacatccggatcctgacctttattcttgagttttttgcgctgttcgaccccgaaccggtgctgctcgtccgtaataacaagactcagcgctttgaattccacttcatcctggattaaagcatgggtccctactaaaatatcaatctctccgagagcaagccgctccaaaagctccctgcgccgctttccttttacagaactcgtcaaaagcgcgatatttacatcttcatttgcaaacaacgatacgagagaatctgcatgctgttcggccagaatttcagtcggcaccattaatgccccctgataccccgacagaatcgcagcgtacaaagcgatggcggcgacggccgttttccctgaaccgacatcaccttgcagcagacggttcattcggtaaggggatgtcatatcagcggtaatttcccgaagcacgcgcgcctgtgcggtcgtgagtgaaaacggcaggctgtctgtgaaagcggtgagcttttcagcaggaaacacatggctgatgccttttgactgttccctttccgctttacggaacgcctgcattttcagctgaaataataagaattcctcataaacaaaccggcgtcttgcctgctgtaacgattccctcgtttcaggctgatgcatcgtctgcagggcatgtttgtaatcaggcagcttatagcggattcttaatttttcaggaagcggatcggccgcactgtccaaatgatgctgcagcgcttccttaataaaccgtctcatcatttttacggtgacgttttctttaacggaataaacaggctcaatgcttttatcttcttgatgaggaccgttttttaattcctgcacggaaatggtctgtctgtgtttatcccacttcccagatatcgtgacgacagaacctaacgtcagtttcttttttaagtagggacggttaaagcagaccgcggtaattaaataattgccgacaagcaccctgaatgtcagcctgtttcgttttttgccgtaataggtaagagaaggttctgaatgaaccttcccttctaccgtcactctttcttcatgttttacttcttctaaatccctcagctcatagtcgtcataacggtaagggaaataattcagaagatcagaaatgtcatagataccaagttcgtgcaatgttttttctgtttccggcccaatgcccttaatttccgctatactagtttgctgatggtgtgtcacttgatttcagcgctcctccgaaaatttttttctctaattctcttcccgtcggtgtcgcagctaaaccgccttgtcccgtttcacgcagtgctgtcggcattgtctggccgattttgtacatcgcgtcaatcacctcatcgcaaggaatgcggcttgtaatcccggccagcgccatatccgccgcgatcatcgcgttggatgctcccattgcgtttcgtttgacacacggcacttctaccaatccggcgaccgggtcacatacgagaccgagcatatttttcagtgtaatcgccattgcttccgctgattgctgaggcgttccgcccgccatttccacaatcgcggccgctgccatgcctgatgctgacccgacttccgcctgacagcctcctgccgctcctgaaatactcgcattatttgctacgacaaaaccgaacgcgccggctgtaaacagaaaacggatcatttgttctgtcgtagggttcagcttatgctttacggcaaataacgttcccggcacaaccccggcagagccggcggtcggtgtagcgcagatcgttcccatcgccgcattgacttcatttgtcgccacagctttagaaacggcgtctaaaatcagattgcccgacaggcttcttcccgattggatgtatgcctgaagtttcacggcatctccgcctgttaaaccggtctgactcgtgacgcccttcagccctttttcaacagctgcttccatgacggagagattgcgctccattcctgaaaagatttcttcccgtgttttttgcgtcacttccatctcttgggtgatcatcacttccgaaatcggaatttgtttttcttgagtgatttctattaattcttttacattacgaaacatgtcattttcctcctgactttttagtcagctatcttagtaacctgtataatattaggaagtgttgaaagctcgtcaagcacttcttcttcaatattctgatcgacctcaatcgtcatcagcgcaagctggccgacgtccttacgcgccacttccatatgtccgacgttgatggagaatttcgcaagcacattggcaacgcctgcaatcgtgccgaatttatcattgtgaacgactaaaatagccgggtggtttccggaaagtcgcagctcaaagccgttaagctccgtgatttctatttttccgccgccgatggaaataccggtaagggcaagctctccctcatcatcagaaatgacgatacgcgccgtattcggatgaacgggcacggcatcctctgtacggaactctacatatatgcccttctcttccgcaatttgaatcgctgttttaatccgttcatcaaatgtatcgaaatcaagcaggccgccgataatcgcgacatcagtgccgtgacccttatacgtttctgcaaatgatccgtaaaaagacacaacgatccggcggggctcccgcctgaataagcttctggccactctgccgatccgggcggcgcctgcggtatgtgaactggacggaccgatcatgaccgggccgataatatcaaaaacgcttctatacttcatgctggtttgctcctccttaacatcacttcattcagcgcttttctttagactaattgaacatttctcaattggcaagcaggcacactgccgcactgccgcaggtaaataaaggcataagaatagaagggcctgataagcccttctattctgccgcaaatatatatggatacagaggctgtctgccgttatggatttcaacctcgatatcttcacagacactagcaatatactcagcgagtttctcagcttcttcttccggcgcgtcctctccgtacaggatggtgacgatttcatcttcttccccgatcatttcatccagcagcaatttcgccgcacttatccgatcttcggcgctgccgataattgaactgtttaaaatgccgataaaatcaccttttttaatatctttgccgtcaatatgggtgtctctgactgaatatgtcacctgtccgcttttcacattccggatggcctcaagcatattggcttcatttacatcagccggctggtcagggttaaacgcaagcagggcggtcatgccttgagggaccgtttttgccggaatgacaatgacattttcttcagccacgctcgccgcctgattggcagccatcacaatattggaattgttcggaagaatgaaaaccgtctccgcattgacagactgaacggcttcaacaatatcttccgtgctcggattcattgtctggccgccttcgattacgtgtgaagcgccgatgctcgtaaacaattcagaaatgccctctcccattgccacagtcacgatgccaaaaggcttgcgggcttctttcataacgccggccggctttttttcatcatgttcttggctgatgattgaagtatgctgttccctcatgttttcaattttaattttaatcagatcgccgtaacgctgtgcgagattgagtacgttccctggttcttcggcatgaatatgaactttcgccagcgtatcatcagccacgaccagcaatgaatcgccgaaacggctcagttcgtttctgaacgcctcttccttgaacgtccgtttatcttgatccagcctcaccatcacttccgtacaaaatccgaattcaatgtcttctgtactcagcatgctctgcgcgcttttatgatgctcggcattcaccatatcatcgagtgccggaagaaccgcttttttcggtacggcctctccttttaaagcagccaaaaagccttcatatacacaaagcagaccttttccgccgctgtcaacgacaccgacgtcctttaaaacaggaagcagatccggcgtgcggttgagcgacgcttccgcttcttcaataacggcctccatgactgaaataatatcggtttcttctttggccgaggcgaccgcttttttagccgcatccttggccacggttaaaatcgttccttcaaccggtttcataaccgccttatatgccatatccactcccgcttggagtgctgcggcaaactcttgggcgtcaatttggtttttgttttcaatgctctttgtgaaacctctgaacaattgggacaagatcacccctgagtttcctctcgctcccataagcaggccttttgacagggcgatgccgactttgccgatgtcgggtgagtcaatgtgctctacctctcttgcaccggatgacatcgataaattcatatttgttccggtatcgccgtcaggcacgggaaacacgttcagcgcatccaccgcggatgcgttttgagacaatgtctcagcccccgccagaatcattgccgcaaaagctctcccatctaagtttcgtctagacaatactcatcctcctcactacgggttcgttactcgtacgccttggacataaatatttacagaatcaactgcaagtccgattgtttgatttactgtgtattttaccttcgtctgaacattgtgggctacttcggatattttagtgccgtagctgacaataatgtacatgtcgatatgtatttgttcggcttcctgacggacatgtacgccttttgcgaagttctctctccggaggatttcagacaaaccgtctttaatctggttttttgaggccatccccactattccgtaacagtcaatggcagcgcctccggcaaccattgcgatgacttcgttggatatatcaatctgtccgtattttgtcttcatttcaatggacacacaggttcctccttcaggtgcatagagttatcattattctactatatgtatcccattatgaaaagaaaagatacagacagcggccttcagcgcggaaatgtgattggttttacatgtcaagtgatttttcttgaaagtaagggaaacaatagttgcaaacggtttttagctgtggtaaattatttaaagtattgtataacgaaagcatctgagacactatgtttaaaaagatgtttcgcgcagttaggagggaaacaaatggcacgtaaatgttttattacaggtaaaaaaacaaaagccggaaacaaccgttctcacgcaatgaacgcttctaagcgtacttggggcgccaaccttcaaaaggtccgcatcctcgttgacggcaaacctaaaaaagtgtatgtatctgcccgggctttaaaatccggtaaagttgagcgtgtataagcaaaaatgaacgcctgcccttttatgcggcaggcgttttttatgcgttcaaagagggcgatttcagcttcttgggcttactcttttctaaatgagcccagcatcgcccggacaattcctcctaaaaacttcggcaatttaatggtataaaatttcattttgtcccctcctataagtcccgtatccgctgcgttcatcactttaggattcatggttttttccgcatatggcagaagccgcttttctaatccgcgctccttaccattattaatatgccttttgcaaacgaaaaagtacctcgtgaatgaatgagttcgttactaatacatagtgtggaacccagaggaatatgacaattatcaaggggatatttaaaaccgtcgagtgtcaggccgtctgccgcttccgtaaacggaatgaaagaaatatagcgtctgcgcactttttcttcaactgtataacggccgggcccgaacatctgaatgtcattctgccggtcgatcagcttgacatcggtatgcttatgtaaggctttatacagcagctggatgttccctaaaaagtgatcggctcttccgcccgtcacaccgaatacccgaatgttttccggttctttttgtaaagcccagtcaagggcgagttcaagatcggtataatctttttccgcctgatacacatggagggccggcgccgctttttgaatctgcatgagctcctcttccgtaatgctgtcaaaatcaccgaaagcttcctgcggaatgattccggcctccaaaagagcaaccgtccctttatcaactccgacccacgtcgtatctccgtctgtgtattcggatagatcgggaataagctcccgcgggccgcccgcaacgatattgattgtcttcatatgctatcctctctcttagacgcgaaaagagccggcggctttcaccgggctctttttcagcatgtttataatgcgtttcggatgtcagcgatagcttttttccgatccggctgattatatacggcagacccggcaacaagcagattggcgcccgcttcagcgcataaaggggctgtttctttattaacgcctccgtccacctcgattaaaagctcagacaggcctttctcctcagccagctgtttgacctgacggattttcggcagaaccgaatgaatgaagcgctgtccgccaaaaccggggttaaccgtcattaacagcacaaggtcaagctcctcgatcacatgttcaatcatttggacgggcgtatgcggattaagcacaactcccgcttttaccccctgctcttttatcaattgaatggtccggtgaagatgcggacacgcttcagcgtgaacggaaaggatgtccgcaccggcttttgcgaatgccgggatgtagcggtccgggttttcaatcataagatggacatccagcggcagatcagtcaccggacggacggcttcaacgataagcggcccgattgtaatgttagggacgaaatggccatccatgacatcaatatggatatagtccgcccctcctttttccacgtctttaatttcctcgcccagtgtagcaaaatcggcggaaagaattgatggcgcaaccttaatcatattaatacctcggctttctctcttttatttcctgcataaattctttgtaatgctcgtagcggtacggctgaatctctccttcttccaccgcttgctttaccgcgcatttcggctccttaagatgcagacagcctctgaatttgcaggaggcgcttatttctctgatctcagggaacgtgctgcccagctcttcttcctcaatgccggtaaattcaagcgaactgaaccccggagtatccgcaaccagaccgcctgatgtatgaatgagctccacatggcgcgtcgtatgttttccgcgtcccaaatgcgcggaaatctcgtttgttttcagctcaagctccgggctgatcgcatttaaaagcgaagattttccgactccggactgaccggcaaacaccgtcgttttgtcctcgaagtgtttcacaatgcctgttaagccgctgttttcttttgatgatgtcacatatacgtcataaccgatcgcctgatagtctttcacgtaagaaagtatcgcctctttcgattccccgtctgcagctaagtccattttggttatgcagatgatcgggtgaatgccgttggcttccacaaggacgagaaaacggtccaataaagacgtgctgaacgccggctgaacggcagaaaagacgagaacggcctgatcgacatttgaaatcggcggcctgatcagctcatttgttcgttctttgatttccagcaggtagccttctttatcattttcagcctgataaacggcataatcgccgaccaggggcgttattttattttttctgaaaatgccccggcctctgcattgaatgatcttgtcctgtgattcatccaagacataatagaatccgcttaacgcttttataattttgccctcaggcatagggtccctccttatcagtcattatctttcgggtattcaatcgttttgtagctgacgactttatgatcgaccatcacttgataataccccttctgtccctgatcaatcttcagttcaattgttttttcggtcggctcttttattttaaatgagtcatacgtatcagagatgctgtggtccttatcatcgatggcgatttgcacttcaagctcttccccttcatgttcgggttcgtaaggaatgctgattttttcttttaccgttttcgccggtttttcttcaggtccgagcgagaacgtcacttcaacattacttcccggcttaaccgcagtgccggctgacggctcttgtttcatgacttgtccttccggcacgtcatctgaatgggcttgtttttcaacaagctgcaggccgttatcttcaagataccctgaagccgcttctttgctgtaagtctttaagtccctcagcgtaacgtccgccgggccgaggctgaccgttagattgacttcatcgtcgcttgcgaccatatcggtgccggctgacgggtcctgatcaattacggtgccggcctcgctgtcatcgttttcttctttgacattgacatgtttgaaacctttttccttcagcgctttttttgcgtcgccgatctgccgtcctttcacgtcgatcagctgggttttcggttttccgatgcttttgtacagttttacagaagagccttctttaacggtagaccccgcttttgggtccgttttgaccattaattcctcttctattttttcatcttcaatatccgttatatcaggatcagcccggagcccgttcttttcaagcagggcttccgctttttcgtacttcatgccccgtacttcggggacgcttacatctttaggcataaataaagacgggaacacggtgaccgcaagaacagccgccataatgaaaatgaaacagacggccagcaaaacccacggccatttccgttttttctttttggctggctgctgttccttatcatccgtctcccccggcgtttccgcctgagacgcggcttttgcgccgtcagtaataacgggaatggcttttgtcatttcctcatcatcctgcacggaaaatttttgttcattcagcctgccggcgtcaaaagccgttctgatgtccgcctccatgtcctcggcgctttcatagcggtgaaacgggtctttggcggttgcctttaaaataatgttttcaacgctctgcggaatggaagggttccactttctggcggaaggcgtttctgtttgcaggtgctttagcgctatgctgacggctgattctccgtcaaaagggattttgcctgttaaaagctcaaacagcacgatgccgagcgcgtaaatatctgattttttcgttgccagaccgcctctcgcctgctccggagacaaataatgaaccgagcccagcacagaattcgtatgtgtgattgtcgtagacgtaagcgctgtggcgatgccgaaatccgtcaccttgatatgccctaaatgatctatcaatatattgtgcggtttaatatcccggtgcacgatatggttttgatgggcatgggcgatggccgagacgatctgctccataacggacagcgcttctttcggatgaagcggtccgtgtgcggttatgtattcctttaatgtcatgccttccacatattccatgacaatgtaataaatatcgccttcctccccgatatcgtaaatactgacgatattcggatgatcgaggcttgatgccgactgtgcttctcttctgaaacgcctgataaaatcaatgtcattcacaaagtcaaaccgcagaattttaattgcgacttcacgttcgagaatgatgtcctcagctaaaaaaacgtttgccattccgccgccgccaatgggccggaggatatgataacgcccgctgatccgcttgccggttagcacttgtcttcaccctcttttgcatctgcggaaaactcaatcaacacagccgtgatgttatcttcgccgccgttttgatttgctttgctgatgagaaggtctactttttcctgaggatcagattcggcttgaagcatttgtttgatctcgtgatcttctattttatttgacagtccgtcagagcataaaagcagctgatcgccgtcagacagttcaaaagaacgggcgtcggggctgatggtttcatctgtccccagcgctctcgtcaatacatttttccgcggatggtgctcggcgtcctctttcgaaatttcccccgtcttgaccagctcattcacaagcgaatggtcctcagtcagctgagtgaattccccctcttgaagcaggtagcaccggctgtcaccaatatgagccacagtgacaaacttccccgtgaataaggcgcagacaatggtggtgcccattccccggcattcttcattcgctttagcgtgatcatgtactttgacattcgcctcatgaatccggtctttcagccaatcctcgcaagcggacggcagagaaggaaccgtttcggtccggttccactgctcttccatcgccgcaaccgccatcctgctcgctacatctccggcaagatgaccgcccatgccgtcggcgacaaccgcaagcaccgcgtcttcttttgtgaaaatgcccgccgcatcttcattatgccggcggactttacctgtatctgttttcaaggctgtaatcaacctcttcacctcgtctcgtcttgacgctccttcgcgcgaagctgaccgcaggccgcgtcaatgtcatggccttgctctcttctgatcgtgacatttacaccgcgggattttaacgttttttcgaatgcgaaaatctgatctctcggtgtgcggacgtaatcccgttcaggcacatagtttaccggaattaaattgacatggcatttcacgtcttttaacagttctgcaagttcttctgcatgttcgacctgatcatttacgccgccgaacagcccgtattcaaagctgatccgtctgcctgttttctcgatgtaatatttgacggcctccataaggtcaggaagcttataggctttgttaatcggcatcagacggcttctgatttccgtattcggagcatgcagagaaatcgcgaaattgatctgcattttttgatcggcgaaatcgtaaatcttcggaatgattccgctggtggaaactgtgatatgacgcgctccgatgttcagccctttatcgtggttaatgatttttaagaaagcgagcatttcattgaaattatcaaacggctctccgattcccatgatgacgactgagctgacgcgttcatccgtttcatcaagcgccttttgcactttcacgacttgagcgacgatttctcccgcttcaagattccgtttcagaccgccgagcgttgatgcgcaaaatgtgcagccgatccggcagccgacctgtgtcgttacacatacagaattaccatactcgtgtctcattaaaaccgtttcgatcgtataaccgtcatgaagctcaaataaaaatttcatcgtgccgtcttgagatgtctgttttacagccgttttcagcgttgtcagcacaaaattgctctcgagtttttcacgcaggctttttgagaggttcgtcatttcatcaaatgaagaaacccgcttttcatagagccattcaaaaatctgtgctgcgcggaacggcttttcgccattctcggtcagccattgtttgatttcatctaattcaaaagagtaaatggacggctgctcagtccgcagctctttccgtacgcttgtcttttttaattgtgtcattttttatcccttctttctcatgctgctaataaagaaaccgtctgttccgaaataatgcggaagaatttgaaggcttccatcctgaacaaagggtctcgccttttcaggcagccgcttttcaagagacaaatcgggttcaaactcagggtgttcttgtataaacgcatgcataacttcttcattttctgtccgatccattgtacacgtactgtatacgagtgtgccacctttttttactaatggggcgatttcccttaaaatgccgagctggatttctgacagccgtctgctgtcctccggcgtcttcgtatatttcatatcgggttttcttctgatgacgccgaaacctgagcaaggggcatcaacgagaatacggtcaaaccgttctgcgccaaaggcctctcccgcttttcgcgcatccatcgtttgcgcgtcgatgatcgtaagtccgagccgttctgcgccctctttaatcagcttcactttatggcggtgaagatcaagcgatgtgaggctcccctcgttctccatcagttccgcaatgtgagccgactttccgcccggtgcggcgcatgcatctaaaacggtttcgcccggcttcgggtccagcgcccgcgcgacaagcattgagctttcatcctgtatggatacccggccgttttggaaaaatgccgtgttcgcgatgcttcctttcaaaagcttaatcgcatcaggagaaaggtctccggcttccgcttccagaccggcattctccatctcattcagcaccgtttccctgtcgctctttatgtgattgacacggagcgtctgcttcggcggaatgagatgaatccggcagattttttcagccgcctcaaagccgtacgcctcgacccactcttttacgagccattcgggatggcttgtctctgtagaaagacggagaaccgggtcttcaatttcagcaaatgacggcgccccctcacgctgcagggagcggagaatgccgttgacaaaggacgcaatgcccttatgcccgcgttttttggcgatttcaaccgcttcatggatggcggcgcgatccggaattttttctaaatactccatttgatacgcggacagacgaagcagctgaatcacccacggcttcaccttattcggcttgcggataaaaggcttcagcatatagtctaaggcgattttattttgcagcgttccgtagacaagctctgtcagcagtcctctgtcctgatcgctgagcgtgttcgttttgataaccgatgtaagaagcaggttgctgtatgcctgattttgctcaagcttctcaagcgcttcaagggcgagctcccggacattaattttcttcatttgctgctcctaacacgtcaccgggctgcacatttttgcctcttacaaaatcttcgcccttcatccgttttttccccgccggctgcagctcagtgattaaaagggcggtgctgtttcctgatgcgacgacaatgccgttttgctccgtgcggatgactgttccgggcgcagcatcagtttttgccgcaactttttcagaagcccatactttaatagtttgaccgttcaaagttgtataggcgacaggccaagggtttaaacctctgatctggttgtagatctcttctccgggctttgcccaatcaatccgctcctgctcacgcttaatgttaggcgcgtaagtcgcttttgattcgtcctgtttgatcggtttaatatttccggagatgacgttcgggacggtctctgacaaaagctttgcccccgctatgcttaatttgtcgtgcagcgtgccgacgttatccgtttcatcaatttccacttcgattttagaaatcatatcgcccgcatcaagcttttcaaccatatacatgatcgtcacgcctgttttcttcttgccttggagaatcgaataatgtatcggcgctccgcctcttaattcaggcaatagtgacgcgtgtacgttgatacagccgtatttcgggccgtccagcagctgcttgggcaggatctgtccgaatgccgccgtaacaatcaggtccggcttcaggcttagcactttttctatttcttcttcgagccttactttttcgggctgaagcacgggaatgccgtgacgttcagcttcagcctttacaggagggggcgtcatgattttttttctgcctttcgggcggtcaggctgcgtaacgacaccaaccacttcatatccgtcttcaataagcgtgcgcaggacgggaactgaaaagtcgggcgttcccataaaaacgatccttgtcatccaatcatccttccatttctgccagttcttcttcagtgtagtaagccgtaatttttgatgtgaataaaatgccgtctaaatgatccatttcatgctgaacggctctggccaaaaaaccctccgcttctaaaataaacggttttcctttacggtcgtgggcttttacctttacgtaatccgggcgggtgacatcaccgaaaaccccgggaaaacttaagcagccctcgactccggtctgttcaccgctcttttcaagaataaccggatttacaaggtcgatccggccgctttcttcaccgatgtccacgacggccgctctttttaaaatgccgatttgcggcgcggcgagaccgacgccatccatttcgagcatcgtatcgtacatatcgtcaagcagtttttttaattttttatcaaacactgtcacttcatcggcgggtgtttccagaacctccgccgggtgtgtgacgatttttttcacagccaaaattttgccctccaaaaactaatgttacatcagcatgtacggattcatatcaattgaaatcattacatgcttttgcgcaatgtcgcgtttataatgctccagtatctttttcaactgaatctgcaactcgttttcctgtctgtattttatcacgcattgatagcgatatctatctttgatcctggcaatcggggaagccgccggcccgagaattttcgtatcaggcccgcatcccgctcttaaatagtttgtaatcttttctgcggtgaccgcggcttttgccgcttcttcatgagaaacggtcaccagcgccacgtaataatacggcgggtatgattgggtccgtctgtgcgccatttccttctgaaaaaaagtttcatagtcgtgcattttcgtcagctgaatgctgtaatgagacggtgtatacgtttgaatgaccaccgttcccggcttttcatgccgcccggcccgtccgcttacctgcgtcagcagctggaatgtcttctccgcggccctgaaatctgggatgtgaagcgtcgtatctgcgcttaatactccgacgagcgtcacgttcggaaaatcaagccctttcgcgatcatctgcgtaccgagcaggatatccgctttcccttcaccgaacgctgacaacagtttttcatgggcgccttttcttgaagtggtgtccacatccatcctgatcacacgcgcctgaggcagcactttggtaagctcctcctccacacgctgcgttcccgtgccgaaaaagcggatatgttcgctgccgcattccgggcatgttcccgggacaggttcctcatggccgcagtaatggcatttcagcctttgtccgtagcggtgataagtcatggaaatgtcgcaatgcggacattgcggcacataaccgcaatcccggcacatcacaaacgaggaatacccccgtttattcagaaaaaggacggcctgctctttttttgcaagcttctcttccagctgttccatcagctctcttgagaacattgatctgttgccgtttctcagttcttctctcatatcaacgagagaaacgtcaggcatgagctggcggtttacgcgatgttttaacggaagcagctcataaacgccttttttcgcccgcgcaaatgactccaatgtcggcgtggcgctcccgaggacgaccggacagctgtgatgctcggcccggcggatagctacgtcctttgcatgataccgcggcatttcctcctgcttataggaagattcgtgctcttcatcaataatgatcatgccgagattttcaaacggggcaaagatggccgatctggctccgacgacaagccggacttccttgcgctgaatcttccgccattcatcgtatttttcacctgtggataatccgctgtgcatgaccgcaacctgtgagccgaagcggcctttaaaacggttgaccatttgcggtgtcaacgagatttccggaacgagcacgatggcttcttttccttttgccagcactttttcaatggattgcaggtaaatttccgttttgccgcttcccgtgacgccgtgaagcagaaagacgtgatggacatggtcggctacagcttgtttaatcggctcaaaagcggcctgctgctcttctgtaagagagagcggctctgtttttttgaacattctgtcctgataaggatcacggtaaacctcctcaaagctttccgtaagaagcccctttttaagaagcgttttcagcgtcgcggaactggaatcggtctttttgcaaagttcagccgcggaaatcttttctcccccgccgataaaataagtaagcacggcgagctgtttagaggcctgctttgtcaatgaatctgcgtgccgggcgagttcttctttgtctgcccccgcttcgatcatgcggatcatttttttattcgttttttgggcgactttatatgtgacatcaatgcttcctttacgcacgaatttctgaagtgacgaaagaatgctttcatcggtaatatccgagtacagaagacttttttgattcctgaaaagctgtttgatgtccggtgtcagcgcttcttcgtcaacgactttcagctctttctcgtacttcgccttcaatgcggcgggcagcattgcctgaagcgccgtgattttaaacgacagcgttttgtcagaaagccatgtagacagctgcatcagttcctcagtcagaacgggcgtcaaatcaagaagcttctcgacttccttcattgagccgccgtttaattcggacgaatctttcaaaccggtcacaaatccttgaagcttgcgcgggccaaacgggacaatcacccgcatgccgacttcgatcatcccttttaaatgatcgggaattttgtaatcaaagggtctgtcaatgtttttggagctgacatcgacaatgacttctgctacattcatacgggttttcggtcctcggctttcaaagctgtcatttccttcagcatttcaaaggaaacgtcaagtttagacataagcgcaagctcccgttttcttccgtcccggaaatagaaggtgacgacattcgtatccgtgccaaatccggccccttccgctttcacatcattcgcaacgatcatatcaaggtttttctgttcgagttttctgcgcgcatagcgttcgacgtcttgcgtttcagccgcaaatccgaccagcagctggtgtgttttccgttcgccgagttctttcagtatgtctgccgtacggttgaattcgatcacgagcgaaccgtctttcttcttcattttgtgatcagaaacagcagccggcgtaaaatcggccacggccgccgtcttaatcaccatgtcgcatgaatcaaacacagaaagcacggcttctctcatatcggctgccgattgcacaggaagaaactgatacagcccgactggcggctctattgacaccgggcctgaaatcagcgtcacccgcgccccgagacggacggcggcttcagcagcagcgtagcccattttgccggtggatttatttgtgaagaagcggacagggtccacggcttcgcgcgtcggaccggccgtaatgacaatatgttttcctttcagcggcgcatcgtcttcaggctccttaaaatgctctctgacacgctcaacaataagctccggctcctccagccttcctttgccgacatatccgcatgccaaatagccttcactcggctcgataaagcggaccccgtcctgataaagcacagaaatgttccgtttcaccgccggatgatcatacatatggacattcatcgcaggcgccacccagaccggggcctcagccgccagcaccgtcgttgtgagcatatcatcagcaattccgttggcaagcttgccgatgatatttgccgtagcgggcgcgacaataattaaatccgcccagtcagcggcatcaatatgagaaatcaccttcggattttgttcattaaatgtatctgtatacacttcattccggctcagcgcctgaaatgtcagcggagaaacaaactcacgcgcggactcagtcataatcactttgacatttgcgccggcctgaaccagcttgctcgtgagtgcggaagctttataaacggcgattcctccgcttacgcatagcaaaatgtttcggtttttcatgaagtcttctcccctttatgaaagcattggacaaatcccaaacggaaaaaaataacaacctatgtagagataggttgctacgtgtgcttgttattcgctgtcttctctttcaaacgaaagcaggcccgcgtcaatttcttctaaagctttgcctacatatttgtgagaaatggtatgttcaatctgctggtcctttttgatctgcatttcacgggcgcgtcttgcagacacagtcaccagcgtatatttagaatctaatttattcattaaagagtcaattgacggatctaacataagttattctacctccagcattttcttatatctcggagcaacgcgttcacgttttaagtgctcggcgagaacgattgcgttaatcttatcacaagccgtttggatatcgtcgttttcaacgacataatcatacgcgtccatcatttcgatttcagcttttgcggcattcattctgttttcgattaaatcgtcggtttcagtccctcttgtcacgattctgtttttcagctcagaaagactcggcggcgctaagaagataaacaggccttccggaaatgcattccgcacttggagcgcgccctgcacttcaatctctaagaagacgtcttttccttcttgaagcgtctgttcgacataatcaacgggcgtaccgtaatagttgccgacatattctgcccactcaagcagtttgttgttttcaatcatgcgctcgaattcatctctggatttaaagaaataatcgacgccgtcgacctcgccctctctcgggtttctcgtcgtgactgaaattgagtattcaaatttcgtgtcctgttgtgaaaatattgcttgccgaaccgttccttttccaactccggagggacctgagagaacgattaataaccctctttctttcatgcggcaattacccctgcccttcatccataatttcttctttcacagaaagtctgtgtgcaactgtctcaggctggacggcagataagataatgtgatcactatccatgacgacaactgcacgggttcttcgtccgtatgtagcgtctattagcattccgcggtctcttgcatcctggatcattcgctttattggcgcagactccgggctgacaatcgaaatcatccgattggcggagatgatattgccaaatccgatattaatcagtttaatcgtcatcttctacgttccccctgtaaaatagacgtctctagtgtaacctgaagagaccgtctgtaaacaatacgcacagtcgctattctatattttgcacttgttccttcaatttttcaatagaacttttcatttcaacgacaagctttgtgatttgatgatcattggcttttgagccgatcgtgttcgcttcccggttaagctcctgaacaaggaaatcaagtttgcggccgactgccccgccttcttttaatatatcacggaattgaacaaaatggctcttcaatctggtaatttcttccgttatatcagaacgatcggcgaaaatggcgcattccgtgatcagcctgctttcgtcgagcgcgtcctccgtccattccttcattcgggcgtaaagacgctcgcggtattgaataacaacggccgaagcgcgctctttcacctgttcggacagcgtctcaagccgctcaatgtgcagaaagcagtcttccgccaaaagccggccttctttttccctcatgtcacaaagttcctttacagccagctcagcggcttccctgatgacttcttcaagcttgtcatcacgcatctgttcttcgtgaatctgcgcaatatgttcaaatctaaagaaatccattgcatcgggttctgcggccaggctgtagcgctctttcatggcgcgtgcggcgctcacatattcatcaaggagctcccaatcgatgttcaggcttctttttatgagcgcgtcactgttgacagtgagaaacagctctactcttccgcgctgtatatgctgcaatatcgtttgtttcagcttatcctctacatatagcaaaggccgtggcaggcgggcgttcacttctttgaaccggtaattgacggatttcaattcaacggttgccgagagatcgccttttgtgctgcttgcgctgccgaagcctgtcatactccgtatcatatgaaacacccaattctttcccgttatcaaaataaaagggcaatagacatgctattacccctaagattatatcatatggaattatttttttcttgtcaaaagtgaacccgccagcaaaaaagtaggtatgccagacatcccgataatcagcatccaatcgcccggcgtaatcggcactgttttgaaaatcggctgcagcggcggataatagatgacgatggccatcaggaagacagaagaaacgatggcgccgagcagataaatattttcaaacggattccgggagaaaacagacgtttcgctccggcagtcaaacacgtgtataagctgagccaggacaagagtcgcgaatgcaacggtctgtgcgtagggcagattttcaggattgcggtgatagacgatgataaacgctaaaatggttgcggctccgattaaaaaccctcttgatacgactttccagcccagttttctcgcaaacactccttctttcggatgccgcggcttccgcctcatcaggtctccttccggctgatccataccgagggccatcgccggcagcccgtcagtgactaagttcacccacaatatctgaatcgggacgagcggcagcggcagagcgagaagcatcgcaaacagcatcactaaaatttcaccgacgttggaggccagcaaataccggacgaattttcttatattttcatagatattccgtccctcttttatggctgatttaatcgtagcaaagttatcatctaccagaatgagagaagaggcttcctttgccacatccgttcccgtcacgcccatggcaacaccgatatctgcctgctttatggccggcgcgtcattaaccccgtctcccgtcatggcgacgacgtgtccgttttcctggaacgctttgacgattttcaatttatgttcaggtgacacgcgtgcgaagacgtagacatcatcgaccgtttcgataagttctttgtccgtaagctcattcagcgtcttgccgtccatcacacgcccctttttcggaagaagacgcaaatcttttgcaatggcctttgccgtttcgacgtgatcccctgtgatcataaccgttttaatgccggcttcacggcattctttaatggcctgtctgacctccggacggggcggatcaatcatgcctgacaagccgagcatcgtcagatttttttccgcctgctccattgtcggcttttctccgggcttaagcggtttataagcaatcgcaatcgtacgcaaagcttgcgacgccagctctttcagaaccgcttccgtttctgctttcttttctcctgaaaaaggcgtacttcttgcgccgtgcatcagatgtgatgagcggtcaatcagcacatcgggcgctcctttagtgatgacgaactgctttttttcctgatcctctacaatgacggtcatcattttgcggacggagtcaaacggaaactcggcaaccacgcggtaatgcccgctgagccaatcgtttgaatagccgccctttcttgcagccgtcagcagcgctccttctgtcggatcaccgtcgagtacataacggccgtctttcagtgcgatttcagatgtgttgcacaacgcgccgaaaaccagcatctgttcaagaatcttctcatctttcggcttgatttcccgctcatctcgggtgaaaacgccctccggcacatagccgatgcctgacactttataaattttgccgcctgaccacatatgagtgacggtcattttgttttgtgtcagcgtgccggttttatcagaacaaatgacagaggcgcagcccaatgtttcaaccgccgggagctttctgacaattgatttttgtttgatcatgcgctggacgccgattgataatgccaccgtaacaatggcgggaagcccttccggaattgcggcgacggccaatgacaccccggccaaaaacatgctgtaaagatcatgtccctgtaagacgccgactgcaacgaccaataccgttaaaaggagcgcgacgataattaaaattttgccgagctcttcaagtcttcgctgcagcggtgttgaaaggctgccggcggattccagcatatcggcaattttccccattgccgtattcattcctgtaccgacgacgacgccgacaccgctgccgcgcgttacgatcgtacccataaacgccatattgctgatgtcgcctaacgaaacatccggctttctcaatttatcggcttgtttaaccaccggaattgattccccggtcagcgccgattcctcaatttcaaggcttttcgcttcaacgatccgcacatccgcgccaatccggtcgccgcttgaaaatttcatgatatcgccgggaacgagctccttggactgaattttcttccagctcccgtcccgcaacgctgacacatacggcgttgacagctcttttaatgcatgtaaagacttttccgcccgccgctcttgaaaaaaaccgagaaccccattgacaaatacaatcgccataatcgctacggcatctacatattcgcctaaaaacccggatattaaggttgccgccagcagcacgagcaccataaaatctttaaattgggcgaaaaacacggcgatcgccggtgtcctcttgccctcctgaagctcgttcggcccgtgcttttcaaggcggtttttcacctctttttcggtcaacccctgtttaatggacgtatttgttgctttcagcaaatcggtttgtcccatttcatgaaacttcattcttctcgtccactcccctgcctcgctttagagatgtcactctgtaaacaagcttattctgactcgtcccttttcatgctataattatcgaatgcaggaagaaggaaagggtgttttatatgtcttttgatggcatgtttacatacggaatgacacatgaattaaacagccggatcgccggaggacggatcacgagagtccatcagccttttaagcacgatgtgatattccatatccgcgccaacggaaaaaaccacaaattattattgtcggcgcatccgagctattcacgggtgcacatgacaaaccaggcctatgaaaatccgagcgagccgccgatgttttgtatgctgctcagaaagcatatagaaggcggatttattgagaaaatagaacaggccggattagaccggattatgatattccgcataaaaagcagaaatgaaatcggcgacgaaaccgtaagaacgctgtatgttgaaattatgggacggcacagcaatattattctgactgacggagaaggatccatcatcgacgggctgaagcatttatctccgtcaatgaacagctaccggaccgttctgccgggctatgattacaagcttcctcccgctcaggaaaaaatttcgccgcttgccgcggatgaagaggacgttttgcgttatctcagttttcaggaaggacggcttgaccagcagatcgtcagacatttctccggtgtttctccgctgtttgcaaaagaagccgtgcacagagcgggtctcgctaacaaaataacgctgccgaagacgctgattgaaatgttccatgccgtgaaagattgcaggtttacaccgaacattacgacagccggcggaaaggaatacttttatctcctgtctctcacacatgtaaacggagaggagcgcacctttcactcactgagtgagctgttggaccggttttatttcggcaaagcggaacgcgaccgcgtcaaacagcaggctcaggatctcgagcgttttgtcgcaaatgaacggaaaaagaatgccaataagataaaaaagctggaaaagacgctcgactactcagagaatgcgaaggaattccagctatacggcgaactgctgacggcaaatttgtatatgctgaaaaaaggtgacaaagaagcggaagtcatcaattattatgatgaagaaagtaagacggtgaccatccctttaaatccgaacaaaacaccgtcagaaaacgcgcagatgtattttacaaagtatcaaaaggcgaagaattccgtcgaggtggtaaaagaacagatccgtctggccgaggaggaaatcgcttatttcgatcagctgatccagcagctctcctccgcctccacaaaggatattcacgaaataagggaagagcttgtggaaggcaaatatctgcggccgaaacagcagagaggacagaaaaaacagaagcagcacgttcctgttttggagcaatatgaatcttcacggggattgacgattcttgtcggcaaaaacaataaacaaaatgagtacttaacgacaaaagctgccgcgagggatgatttatggttccacacgaaagacattccgggttcccacgttgtgattaaaagcagcgatccggatgaacaatccatactggaggcggctgcgatcgccgcttatttttccaaagcgaaagattccggctccgttccgattgattatacaaaaatcagacatgtgaaaaagccaaacggcgcaaagcccggatttgtcacctatgacagccagcataccgtatttgtcacacctgatgccgaccttgtcatacggctgaaaaaataaatgcacctccaagctgaaacccgcactcggcttggaggtgttttttattacgtataaacggagacgaaactctcccagccgtcagaaccgatctttacagtatctgatcagtttcccgtcatgtctgcatgatccgccgggccgtctgtgatttaaacggtcacacctgatttggcggcggatactttcaccttccctcaccgaacctgagcacatccgggcgggtctctgacctttcctttgtatgcgggcgaaatccaggcggcatcgggatcacatacatattccgcatcacttcgcaatcctgaccgcttgtcggcatataccattcaaactgcccgctttcgttttgaatttttcacattcggcggactgtcaggacagtataaaaaacaccctgcctgatgacagacagggtgttttttatggtcttcttcttttctcaaataatcgatccacttcttcagccaaatcagcagtaatgagaggttttatgtcctcagccagtcttttcgtatgtgccgggcttgcgccgcttgttgatacggatacttgaatgcgccctttgcggatgatcttcggcatatacacgctgccctgttcagcctcgcttacacaattgaccagctgcgtttcagaagcgctcgcggctatctcccgattcacgctgcggtcatttgtcgcggcaatgatgaaaaaagcgggcgcgagatccttcatgtcaattttacgggaaacccagcggatacgtccttcatccgccagctgtttaatttcaggcagggcatcgggactgattacagtaatatccgcgccttccggaagcactgttttgagtcttcttaaggcaacattgcctccgcccgcgacgacaattctttttccgctgagattaatgtgcagaggcagcatactgtccccccttaaaatcaaactgcccgccggggtttcggacagcttccgtcacacggttcaaaaacgcctgcttaatatgcgggtgaaaacctaagtatgaagcgagatgaatattttgattgattgcttgaagcttttgaacttcccgttcaatctcagtcattaaaagcccggtaaacagaagatatggaacgataaaaacgggtgctccgtcatcctcttcaaggccggcaaacacttctttatagtgcgggtcacatgctgttaaaaaacaggggatgacttctttaacaggtgtaatcgcctcaagttttccggcaatctcactgactgcgcttttaactgccggatctgtgcttcctcttccgatcagcaccactttcgcctgctcaatgggcactccggtatcttcaatgcgatgatggaccgcttttacgacttcatcgtctactccgatcggaacaccatatgtcacttttatatcgggatgcagggccgccgcacgggcgatttcagccggaatgtcatgtttcgcgtgggctgcggtcaacagcagcaaaggcacagccgcaatatgagtggcgccttgtctgacacaagcttcaaatcccgcttcaatagacggttcctgcagttctaaaaaacagatttcctgaatgggagcgtcagcgtgcggcatgcacccttttaaaaacgccgccgactctgtctgcgcttttttcagcctgcttccgtgcccgatatataaaatcgcctgcttcatttacaacgcctcgctcaaatccggatttttctgatcagatgcataccagtccagtttgcagtgataattgacgacatcaccgataacaattaaactcgggtttttgatttcttcttttatcactgtgtctgaaagcgtgctgacggtgcagacgactgttttttgcctgtccgtcgtcccccaatgaataaaggctgccggagtgccgccgtctctgccgttttccagcagcattctttcaatctgccggatatttttaattcccatataaatcaccagcgtatcaatgcccgtcgccagcgctttccatttttcttcaaagtcgtcttcttgcttataatgccccgtaacgaatgcgacattggagctcgcctctctgtgcgtcaccggaatgccggcataagcagcagccgcgattcctgatgtaatgccgggaacgatctcaaacggaatggcgttttgcgcgagagcctccgcttcttcgcctccgcggccgaaaacaaacgggtcgccccccttgagccttacaacggttttcccctttttcgcatacttcacaaggaaacggttgatcgtatcctgtttcataatgtgaaaatccgggagcttgccgcagtaaatcagatccgcttcttctccggcgtactgtaaaatctctttgtttaccaatctgtcatataatataacgtccgctttctgtatggctttcattgccttcaccgttaataagtccggatctcccggaccggctccaacgataaatactttccccatagcatgtctccccgatccgttttgaaatcttcccagaacagccgcgaggccgcacttcagctattttaccatatcccgccattgcgggggatatccggctgattgcgcggcctttttggacctattatgctaagctgtttttcacaaagtcaaccagtcttccggtgcattcttcacgttcaaatttgcctgaatcaagtacgagctcaggcgctttcggctcttcatacggtgagtcgatccccgtaaagaacggaatttcaccatttcttgcttttttatataaccctttcggatcgcgcttttcacatatatcgaggtcgcatttcacgtagatttcattaaattcgccctctgccacaagctctctcacctgatctctgtcctcacggaacggagaaataaaagccgtgatgacgatggttccctgctgaacgaaaagcttcgccacttccccgatgcggcgtatattttccttgcggtcatcatcggaaaaacctaagtccttgtttaagccgtggcggatgttatcaccatcaagcacaatgacttgatagccttgttcaaacagctcgcgcgctgcggcgtttgcaattgtggatttccctgaaccgcttaagcccgtcagccagaggatagagcttttatgtttgtttttctgctggtattcttctttcgttattgaggcttcatgccatacgatatcacgatttgtcactctattttcctccttaagaaacgcctgcttcttctttcgttttcagccctttaatcaacacctcgacaacttcaggacggctgaattccgccggcggcatgacgccgcttcgcagcatttctctgacctttgttcctgacagaatgacgtggtcttctctgtcatgcggacatgttttggccgttcccatgttgccgcatttctggcagaagaagctgtgctcgaatttcatcggtgtaatcccgagttcatccgctgtaaattgatcaaacagctcttgcgcttcatatgtgccgtagtaatcaccgacgccggcatgatcgcggccgacaataaaatgcgtgcagccgtagtttttgcggacaagcgcgtggaaaatggcttctctcggccccgcataccgcattgccgccaaaaacacgccgagaaatacgcggtctttcggataataatgatcgagcagcacctggtagctttccattctgacatccgccggaatgtcatctgattttgtttcaccgacgagcgggttcaaaaacaggccgtcaaccgtctcaagcgcggttttttggatatattcgtgggcgcggtggaccggatttctcgtttggaaaccgacgatggttttccagcctttttcttcgaagcttcgtcttgtatcggcaggttcaaatgtaaactcaggaaactgctttgacgcttttttaattaatgtgatcggcccgccgacatacgtatcgccgcgtgaaaataattttttcacgcccggatgcgcggcatcatcggttttatatacgtgaacggcttctttttgtttatccggcgtataaatatcttcgatgtcgacgacaccgtatgtttctccgccgtaagtcagtttcaccgtgtcgccgacggcaagctcagccgctttttctgaatcgaccggaagcgtgatcggcagggaccagacaacccctgatgccagacgcatattttcaacgactgacacgtaatctttttctgtgaaaaatccttcaatcgggctgtaccccccgatcccgatcagctctaaatcagcgaacgaaatcaaatcaagctcaatttctttgtggacggatgtaagattatactgctcattcacccgattaattaatgttcctccgtgcggtgctaaactcataatacatgattcctcccagttaacagataaataaactcagattaataattaaatgcccccgccttgttcatggacagagcgtttctcttttcggatggctttcatcagactggcggctccgccagctgccaaaagcacgctggccatcataaagatggaatagtaatctccttttaacagcagggagacaagcagatacgaaatcgacagtgacaaaaacggcgaaacaacccatactttgagcatcgttttcacgacttctttatgaaaaacgttcggcccgtttttggccattccgataccgataattgatgatgatgtgacttgcgccaatgggaccggcagaccgaagacggaactgataatgacaagccccgcaccggttcctgaaagcagtatgccttctccggctgaaaacctcgtaatctttttcccgttggtttcaagcactttgcgtcctaaaagcagagcgccgagagcgacaaagatgcctccgtacagcgttccttttgacacgctgagtacgcccgcagccaccaaagggcccaccgcatttgcgacattgttcattccggctgaaaaagcttcccaaaaccccgcaaaaagcagcacaattcctaaaatcttctgtttccgtttcgaaatgactcgaatattcagagaactgaataccttcgatacgagaaaagtgaaacagaacgcgacgaacggtacgagcacccaaaaaatcacgatgaccaaaagatgctgtaaaaacaatactttgtacgcgacgccgacaccgacaatcgccccgacagtgacctcactcgtcgacagcggaatgccgagcacattcgccgtgaataacgatagcgccgccgctccgattataatgcagacaatggtgagcgtaatggtttgttcgggaatgattccgccgctgatcgtcttaacgacttcaccgccgccgataaccgcccctgacaggactccggccgcgcagatgatcagcgcatacgttttctttttaacggcgccggacccgtaagcgactcccattgatgccgcggctccgctggctccgatattcatggcaaaaaacagacagaataaaatagcggctaattccatcgggcagctcctttattcatgcagtccgcattctgttttcgccatgccgttccatctgccgctccgcaaatcttccgcggtaaacgcaggtgaagtgcacggttcacagccgatgctcggatacccctgatcatggaggatattgtaatccagctcatgcttggaagtatatctccagatgtctttccatgtccaatggatcagcgggcatactttaatcgattgaaacttgtcgtctttattcaggaaattcgtattcgcccggctcggcccttgatcccggcgaaggccggacagccatgccggatgccctgcgagcgcttctcttaacggcagaatttttctgatgtagcagcactggttcggttctctttcccacagtttatctccgtgagcctcggcctgttcctcgagagtaaggctgggctttttcaggataatgttcagccccggataacgttctttcactttttcgatcgtttcatatgtttctttaaagtgaagacccgtatcgagaaacacgatttccgcgtctttctttactttagaaattaaatcgatcaggacgatgccctcaatcccgaagctgcacgcgtaaacaagctggtctccgtagtggccgtatgcccattttaaaacggacagcgcgcctttataggaatcgtcttccggaaatgtaatcgccggttcctcccatgtgtcatacgtcagcattttttctttcctcctcccggagacaatcaaacagctgttgttctctgccggttgtcttatccctcaatctttttttcatataaaaaactttcaatccagcggaatgaaagacagtgacccggtatagcccttatcttcaaaatgctgtgcatttttctggatgcggcaccttgcaatacacgcaggttgccgggcgtcatcggtccagtccctcagccgctcttgataagctttttagatttgtactaaattttagcacaattctaacagaagtcaacccgagttttttgataggaataatagaacaggccctgaggcctgtttttattgtcattattttttaaaccaatcttttgactcgggattcagtttccatgatttcagtttttcaatgtcagctgaatgaatcgtaccgttttcaagcgcaacttcaatcagcgtgtcataatcggttaacgagtaataaggaagacccgcttttttaaaggcttcttttgctttcggcagtccgtatgtaaaaatagaaatgacgccgaggacttccgcgccctctctttgaagggccgccgcagcttcaagcacgctgcctccggtagaaatcaagtcttcaatcacgactgttttttgtcctttcttaatggcgccttctatttgatttcctttgccgtgcgctttcggtttgcttctgacgtagcacatcggcgcgcccgtacggtctgcgagaagcgcagcatgcggaatgcccgccgttgcagtgcccgcgatcatctccgcctcggggaaatgctccttcagcagtttgccgagtccgtccgccacatcatttctcacttttggatacgacaatgtcagacggttgtcacaatagatcggtgataaaatgccgctcgcccacgtaaacggctcattcgggcgtaaaaagacagcttcaatgtgtaatagatgttttgcgatagcctgtttcatcggcgaacgccctcccattccagtttaattgcttcatatactttaacggggttttccgcttttgtaattgagcggcccacgacgatggctgacgaaccgttttctttcgcaaatgacggagtcgccgtacggacttgatcgtcagctgcgtcactggcggtgcggatgcccggcgtgactgtcagaaatgaaggccggaccgcttcataaatggcttttgtttcatggaccgaacataccactccgtccagcccgcactcttccgccattttgccgtaatgcacaaccgtttctaacagcggcttatgcagcagaagctcttccctcgccacctgctctgaagtgctggtcagctgagtcaccgcgattaaagacgggcgttttctgcctgccggcgtgccttcttcaagcccctcaagggccgcgcgcatcatgcgtgcgccccctgccgcatgcacattgacgagatcaacgccgaggccggccagccgcttcatcgctttattgaccgtagtcgggatatcatgaagctttaaatctaaaaatatatcacagttccgttcttttaattggtgaatgatggcggggccttcctgataaaaaagttccatccccgttttgacaaagagcctttccttttcaaacaagtctaaaaacgttaaagtctcttcccctgatgcaaaatcaagcgcgatgatgggcaggttgtttttcatgtttccagctccttctgatgcattcacttacagattgaaagccgtgttggcgcagcacatgggggagctgttctatgatttccgggcagacgaacggattgacgaagttcgccgtgccgacggcaaccgcactcgctcccgcaagaagaaattctaatgcatcctctgcggtctgaacgccgcccatcccgataatcggaatttgaacggcctggctgacttcgtataccatccggatggcgaccggtttgatcgccgggcctgacagtccgcccgttttatttgctaaaatcggccggcccgtcttgagatcgagcctcatcccgatgagtgtattaatcatcgtcagaccgtcagcaccggccgcttcaatcgctttggcaatttcggttatgtttgcgacattaggcgaaagcttcacatacacaggcactgcggaaacttctttcaccgcttttgtcagttcggccgccatgacgggatcagtaccaaaagcaatcccccccgttttgacattcggacatgaaatgttaagctcaagagcatgcacattcggcgcttggctgatgtgctcggccacttctttatagtcgtccacctgagaaccggcgacatttgcgataatcggcgtgtcaaattgttcgagccaaggcagctcgtgattgagcacatgctcaaggccgggattttgcagtccgatggcattcagcattcccgcgcttgtctccgccactctcggcgtcggatttccgaagcgggcttcgttcgtcgtggctttaatcataatgcctccaaggcatgataaatcgtaaaatccggcatattctttcccgaaaccgaaacatccggaagcggggatgatcgggtttttcaattggagacccggcagattcacctctaacattacagcgccacctcctcagctttaaataccggcccgtcaaggcagacctttacataggatgtatcactttcacccgtgcggcacacgcaggcgaagcaggccccgatgccgcagcccatccgctcttccatcgaaagataaacctctttatggccgtactgctgcttcagagctttcagcatcggtgtcggtccgcagcttagcaggacatcgaattcgagctgcttttcacggatgatatcggtgacaaatcctttctctccatatgttccgtcagccgtcgccacataagtgtctccgtacgcacggcattcctgttcgtaaaaaacatcctttgctgattgaaatccaagcacatgaatgacgtttacgcctttttccgtcaggcgctttgacagttcctgcaaaggcggaacccccactccgcctccgactaacagcgcggttttgccgggttcaatccgccggacgggaaatccgttgccgagagggccgagaacgtctattctgccgccctcttttttcccggacaaaagacgcgttccctcaccgtcagctctgtagataacggatacttcatccgcggcgaaattgacgtccgcaatgctgagcggtcttcttaatagcggtgtgaccgcgtcactcaccttcagatgaagaaattgtcccggctcggtaaggtgccggacaagctctcctttcagcaccatcttataaatccggtcggcaatttctaagttggattgaacagtcaaatgcgcttttttcatatcgtgactgccgccttttgattggtttcggatgcaggcatatgatccgcccggaatgtcatgctttccaatacccgcaaaatggcttcggccgtatctaaagatgtcaggcaggcgactccgttctccacggattcgcggcggattctgaagccgtctctggccggctgtttgccctttgtcagcgtattgatgacaaattgcgcttcgccgtttctgatcacatcgagcagatttttcccttcttcgccgattttcccgacgacttgagccggaatctgagcgtctttcaaataagccgccgttccttccgtcgccaagattttatagccgatggcgtggaaccgcttggcgatcagcagtccttcttctttatctttatcagcaacggtcaacagcactgaaccgtagttcgggatttgaatgcctgaggcaatcagcgctttatagagcgctttttccaaggttgaatctttgcccatgacctctcccgtcgacttcatttcagggcctaacgtaatatccactcttctcagcttcgcgaatgagaagacaggcgctttcacgaacaccccctgctgttcaggctgcagcccctcttgatagccgaaatcagcaagcttttggccgagaatgacctttgtcgccagattcgccatcggaatcttagtgattttgcttaagaacggcacggttctgcttgaccgcggatttacctcaagcacatacacctcaccttgcgaaagtacgaactggatgttcagcaacccaatgatgttaaggccttttgccaaggctacagtgtattgttcgatttttttcttaatgtctccgcttaaagactgaggcggatagacggcgattgaatcccctgaatggacgccggcccgctcgatatgctccataatccccggaataacgactgtttcgccgtcagatactgcatcgacttcgatttctttccccgtcagataacggtcgattaacaccggatgctgcgggttgattttgaccgcatttttcatatagtgaagcagttcttcttcgtgatagacgatttccatcgcccggccgccgagcacatacgaagggcggacaagtaccggatagccgatggatgcagcgattttgaccgcttcgttcaccgacacggcggtttttccgagcggctgcggcacattcagcgcctcaagcgcctgctcgaacttatcccggtcttccgcacgatctaaatcttcaagtgatgtaccgagaattttgacgccgcgggcgctcaattcttccgcaaggttgatcgccgtctggccgccgaattggacaacaacgccttccggctgttccaaatcaatgatgtgcatgacatcttctaccgtcagcggttcaaaatacagtttgtctgatatgctgaaatcagtggacaccgtctcagggttgttgttgataataatcgcttcatatcctgcctgcttaatcgcccagacagagtgaacggtcgcatagtcaaattcgacgccctgtccgatgcggatcgggccggagccgaggacgacgacgctttttcttgatgttacctcagactcgttttcttcctcatatgtgctgtagaagtacggggtttctgattcgaattccgccgcgcatgtatccaccattttatatacaggcttgatggctgcttcttttcgcatttgatacagctcttgttccggcatattccattcccggctgatatatttgtctgagaaaccgagttccttcgctgtctgcaggacggcgaggctgcctttttccgctttcagctcggtttcaaaagcgaccagcttacagagcttgtgcaaaaagaatacgtcaattgcggaaaactcatgaagctgctccactgtgtagcctcttctgaacgcttctgcaagataaaacagccgttcatctccggcctttctgatccgtttttccaaaagcccgtcagaaatctcttccgcatccttcagttccaggtgatagacatcggcttccagtgagcggaccgcctttaacagcgattcttcaagggtgcgtccgatggccatgacctctccggtggctttcatttgcgtcccgagcctgcggtttgccgactcaaatttgtcgaacggccagcgcgggattttagaaacgacatagtcaagcgcgggctcaaaagccgcatatgtttttcccgttacgggattcatcatttcatcaagagaaagcccgactgcgattttcgccgcaagctttgcgatcgggtaacccgtcgcttttgaagcgagggcagatgagcggctcacccgcggattcacttcgataatgtaatattggaagctgccgggatcgagcgcgagctgaacattacagccgccttcaatgccgagcgcgcggatcagctttaatgaaacattgcgcaaaagctgatattcccggtcgctcaaagtctggctcggggcaacgacgatgctgtcgcccgtatggatgccgaccggatcgatattttccatgttgcagacgacgatcgcgtgatctctgctgtctctcatgacttcatattcgatctctttgtaaccggcgatgcttttttccagaaggcactgatgaacggggctgagctttaatccgttttcgacgatctctttcagttccgcttcattcgagcagatgccgccgcccgttccgcctaatgtgtaagcggggcgcacgataaccggaaacccgatccggccgacaaattcctcggcttcctgtaaagtgcggatgatctcactttccggcaccggttcattcagctcattcatcagcgtacggaataagtcgcggtcttccgcctgctgtatggcggacagctttgtgccgagcacttccactccgcattcctcaagaaccccgagttcagacagctcgacggcaagattcagtccggtctgtcctcccagagtcggcaggatggcgtccggccgttcttttctgataatacgcgtgagaaactccggcgtcagcggttctatgtatacccgatcagccatttccgtatccgtcataatcgttgccggattcgagttgacgagaatgacttcatagccttcttcctttaaagcgagacacgcctgtgtgcccgcataatcaaattccgccgcctgtccgataataatcgggcctgatccgatcactaaaatctttttaatatctacgcgttttggcataccgcttccccttctttctcagttgtttcgatcaagtcaatgaatctgtcaaataagtgattggcgtcttccggtcccggtgaagcttcagggtggtactgaaccgtaaatgccggcaatgttttatgcttgagtccttcgatcgtttgatcattgatcgcaatgtgcgtcacttcaagctctgtctcatctattgaagaaaccgtatatccgtggttttgggctgttaaagcgactttccctgtcgcaagctctttaaccggatgattggaacccctgtgtccgaatttcattttttccgtttccgctcccgatgccagcgcaaataattgatggccgagacagattccgaataacggcaccttcccgagtatgccttttatcatttcaatggcttccggcacatctttcggatctccgggtccgttagaaagcatgatgccgtccggcttgagctgaagcacttcttccgccgttacattgtacggcacaacgatgacatcgcattttcttttgtttaactctcttaagataccgtgcttcataccgaaatcgacgagcacgatgcgtttgccgcggcccggactcggatatgccgttttcgccgatacttgagcgacttgatttctcggcagttccgtttctttcagccttgcaagaacctctccgacattctcctcacttgaagcaaacgttccttttaatgccccggccgtgcggatcattctggtgagttttcgcgtgtcgatcccttgtaagccggggatatttttcattttcagatactcgtcaagcgtgtaagccgagcgccagttggaaggcagctcgcacagttcttttacgatcagcccttttacaaaaggagtgatagattcaaagtcatctctgttaattccgtagttgccgatcagcggatacgtcagcgtcacgatctgcccgcagtaagaagggtctgataaaatttcctgataaccggtcattcccgtgttgaatacgacttcacccgcggtatgctccaggctcccgaatgcttcaccctcaaataccgctccattttccagcactagtcttcttttcatttgacgagtctcccttcttcatatgcaagcttaccggcagccatcgttgcaacaggccagccgaagcacttcatcttgttgaatggcgtattttttcctttagataaaaatgtatctttgtcaatggccgcttgtttgtccagatcaatcagggtgatgtcagccggcgcccccggtgcaagcgttccgtacggaagaccgaatgcctcgcaaggttttaccgtcatgaaatcaaccagctgcttcagcgtccacgccccgtttttcacaaaatgtgtgtacagaagcggaaaggcagtttctaacccgacaataccgaaaggcgcaagcttcatatccgtgtttttctcttcttctgtatgcggcgcatggtcagtggcgatgaaatcaatcgtgccgtctaaaagcccttcaatcagcgcctctctgtcctctttgctgcgaagcggcggattcatcttaaaattggtatcaagtcccgggatatcttcgtcacaaagcagcaggtggtgcggcgatacttccgccgtcacgcggatgcccgctttttttgcgtctcttacggctctgacggattctttcgtgctgatatgacacacgtggtaatggcagcccgccgcttccgccagcaggacgtcacgggcgatatgtaccgcttcacaaatggaaggtatacccttcaggccgttcgcttttgaaaaagaaccttcatgcacgctccctccgtaaataagcgagttatcctcacaatgagcgacaatcgctttatttattgaagccgcccgtttcatggcttcatacatcattccggccgtctgaacgccgacgccgtcatcggtgaaggcgaatgcgcccgcttcatgaagcgcctcaaaatctgtcatctcttcgccggtttgtctgatcgtaatcgatgcgtaaggaaggaccctgacagatgaggtttctttgatcctgttttgcagccattccatctgctctttcgtatccggcaccggccttgtattcggcatggcggcgactgtggtaaaaccgccgcgcgccgcggctttagagcccgtctcaatggtttcttttttctcgccgcccggttctctgaagtggacatgaaggtctacgagcccaggtgaaacgaacagtccctcagcgtcgatcaccgtttctccgtctttcgctgtcagaagcccggtttccgaaatgaattcacccgttacccggatatcctgtaccgctttttctccctgttcatttaatatccagccgtttttaatgagataagacataagccgcttctccccttttcacattggtttgcagtgctctttttaagactgccattctgatatacacaccattttccatttgtttaaagattcttgattttccgcattccactaatgttgtgtcaatttcgactcctctgttcaccggtgcgggatgcatgatgatagcatgccgcttcatgctctccgcccgtttttcggtcagcccgtatgcttccaggtagcctttttggtcggcttctgtctgatgcctttcattttggatgcggagcagcatgacgacatctgaagcttgtatggcttcatccgtctgaacacaggtgccgaaggcgtttttctcatcctgccactgcggcggcccggaaaacagcacacgtgcgccgagccttgtcagcacctcggcatttgaccttgccactctgctgtgtttgatatcgccatgaatggaaaccgtcaggccctgaaaggtctcaaattcctcttgaatcgtcattaaatcaagcaatgactgggtcgggtgctgtccgcagccgtcgccagcgtttaagaccggaatattgactctgccggtcagatctttgtaatattcatccgtgctgtgcctgatgacacaggcatccgctccgattgattccagtgttttgaccgtgtcgtataaggactcgcctttttgaacgcttgtgctcgtgccgtctaagctgagcacgttcatcccgagtttcttttccgccacttcaaagctgaaccgcgttctcgtgctcggttcaaaaaacagattcgcaacgaattttcccgcgagatcgggacggactgcaccctcttttatcgcttttgcctctcgcagcagttctgtaatttcagccgcgctcagttcagacatcgccgttaaatgattcatgttttttctcctccgtttccgcttgaaggccgtaaaaaacaccccggtctatagactcggggtgtggttaaagagagaagagccgtacagcttcttcccgttataacccttccaagcctctctggactttctttaaaaggtttacatatgatttggtttttccgatgcaatcgcgtcttcttcatttgcatgcggcaggataaggttcaggatgactccgacgattgccgcaagcgccatgccggatatttggaacccgccttttgatacttgaataaaagcccctccgacgccgatgacgaggatgacggatgtgataattaaatttcgcttgttttcataatcaatgttgttgtcaatcaacattctcaagccgctggaggcaatgattccgaagagcaggaaggaaacgcctcccataaccgcggacggaacagagctgatcagcgctgaaactttgccgataaatccgaagcacagcgcaatcactcctgcgccgccgatgacaaagacgctgaaaactctcgtaattgccaggacaccgatgttttcgccgtatgttgtcgtcggcgggccgccgattaacgaagcgataatcgtcgctacgctgtcccccattatggagcggtgcagtcccggctttttaatgaaatcctgtccgacgactttactcagcaccatttggtggccgatatgttctgacatcgtcacgaaagcgaccggcaccatcgcagcggcaatgcccaatgtcactgacggcgtgtagtctttgaaagggatgataaattcaggaacggcgaaccattttgcatcaatgaccggctgaaaattgacgatgccctgtgtcagcgcaaacagatatccgcctataatgccgatcaataccggaatcaagcttaaaaatccccgtaaaaagatggcgcagataatggtgatggccaaagtgacgccggctacactgaaatgtttcaggctgtaaacgagttccttcgcattcggatcagcatacattgccatattgacggctgtgcttgccagtccgagaccgatgacgatgatgaccggcccgacgaccaccgggggcagcagcttcatcagccaccccgttccaagctgcctgatgagaagcgcgatcaggccgtacacaattcccgccaggaaagcgccgaccatggcagcccccggccctcccgtcgccttcaccaagataatcggtgatataaaggcgaatgatgagccgagataagcgggaatctggccttttgtcaccaagagataggcgagtgtcccgattccgctcgtgacaagcgccactgccgggctcattccgaccagtttcggcacgagtatggttgaaccgaacatggcgaataaatgctgcaggctgaatgacagccaggacaatggattggggacgtccctgactcccaggtttacttttttcttactcatggcgttttcctcccggttgactttcaaatggtataaaaaaacctctttgctttttgcgcaaagaggcatacaaagcccggccgcgtcgatccgcccggctttgtgttttaaaatcctctttgcaaactctctggaatgcatttaaaaagggtgattattcattttcgtaaatggcgaccatatcagtctgatcaacttcgctcagctgaaccatcactttttcagcttttgaggtcggaatgtttttcccgatatagtccgctctgatcggcagctcccggtgtcctctgtcgacaagcacggcaagctgtatcgatgacggccgcccgacatcaacgagagcatccatcgcagctctcaccgtccggccggtataaagcacatcgtcaaccacaatgaccttttggtctgtgatatcggccggaatgtccgcgccttttacaagcggctcttcgttgctcgttttttttgtgagatcgtcacggtaaagggtgatatcgatttccccgacggtgaccggatttccttcaatctgttcgatccgctcggccagccgcttcgctaaataaatacctcttgttttaatccctacaagaatgcagtcattcattcctttattccgttcgatcatttcatgggctatccttgtcagcgcccttctgatggcctgttcgtcgagaataacagctttttgattcactcgtgacacctctccattcgtatataagaagaaaaaacccctcctgccagagcatagaggggttcctttccaggaccaagacacacgtgtatctcttctgtcctatccgttatccttctcagcctctccggactgtgttaaagaatctattcagcttgtttttattatttcagaaaagaaactcgctgtcaatggctatttctcaaatgttcaatgagttttttcatatcttcaggaaggggcgcttcaaactccatgtattcgcccgtccgcggatggtcaaaacctaatattccggcatgaagcgcctgaccgttgaaatcaatggtttttctcggtccgtacttcgggtcgcctgccaaaggaaacccgatatatttcatatgaacacggatctgatgcgttcttccggtttcaagacggcactctacgagcgtgaagtcttgaaaccgctcaagcacgtggaaatgcgtgacggcgtttttgctgctttctcttgttacggtcatgctttgacgatcttttttatctctcccgatcggagcgtcaatcgtaccgtcatcatgtgaaatcaacccgtggacaaccgctgtgtactttctcgtcacagttttattgacgagctgattaacgagtgattcatgcgccatatcgtttttggcgaccattaacaggccggaggtatctttatcaatccggtggacgattcccgggcgcatgacgccgttaatgcctgaaagatcattgcagtgagccatcagtccgtttacgagcgtccctgtcacatggccgggagccggatgtacgaccatgccccgcggtttgttcacaaccaagacatcctggtcttcatagtaaatgtccaaatccatcggctctgcaagcacgtccaattcttccggttcaggaatggtgacgtttacctgatcgccgggctgcattttataattcgcttttacggatttgccgttaacggataccagtccctcttttacccattgctgcacttgagtgcgtgaccagttttctcccgttgaagccaaaaatttatcaatccgttcgctcttttgttcaggctgaacggttatctcaaattgattcatgttattgctccttctttttcccgctgtcaaacagcatatgaataaataaaagtattacaccgacgcacagtgaggagtccgcgatattaaaaatcggatagtgataatccacgatgatgacatgaataaaatccaccacttcctggcgcgccgcccggtcaataaagtttccggccgcacctcccagcattaagccgagagaaattccgagtaacatctgcccttttgcataacgctgtatgtaataaacgattccgataatcacggcgatggtaatgacgtagaaaaaccacatttggccggctaaaatcccccacgccgctcccgtgttgcgatgagatgtgatataaagcacctggtcgatgacaggtatgctttgtcccaattccatatggctgacgacaagccatttggtcaattggtcggcaataataataaaaagagcgataagataataaagcacacacgttcctccagtatacagttacttttatcctttatgaattttatcagtaaaagatgccggagtaaaggcagatcataagcgtatacaaacagacgctgtcactcatacagcgcctgatcatatgcataatctccggttacccagtatggaagggttttcttttcaaattgagcgggataataaaaatcatcagcggttctggccgtcggcagcaccgcaagtttttcaatcggaatgggggcgcctgttttttcacaataaccgtacgtattgttttcaaacttagacagggcaagaagaacatcctgaagttcttcttttatatgatagatcagagttgcttcttggtcgttcattgaaggttcaacagatgctgacatttgaaagcaagaatattcgaataatcttgattgaagttcttctttcatcatgagaagctccgtgtggattgcggtcagttgatcattcattcatcacaactcctgctcttgatgttatagctttattgttgccctcagagcgccatttgaagcccataagaattttcctgccgttctaatcgatgacattgctggcatgtaaaaaagcgcccggctgacaccgggcgctttctcatttattatttttgataatatttttcaacgatttccgcattgcgcagtgataatgtcggatatttcggattggctccgacatctttagaaattacgcgggaacgctcacacatctggccttccgctttttctacggtcatttttcctgttgtaaagctttgcgcgttttccggcgcttcactttcgtcttttactgtcagttctgagacgataaacagctgcgcgatgttttctttaatggatgacaagaggtcgcggttttctttgttcggatacaaagtcaggctcgcttccaatgatcttccgataattttttcgttacgggctgtttccaaagctttcagcacgtcgtttcgaagctccatgaagcggtcgaatttttcttctgtcgcctgactgtccggaacagcaatggtttccggcatatctgtcagctgcacgctcgcttcttcaacaaatgataagtgagaccacatttcatccgccgtatgcgggagaatcggcgccgtcagtttcactaacgccagcagcgtttcataaaagacggtctgcatgctgcggcggtccggatgatccgcatgctcgatgtacacaacatcttttgcaaaatcaagatagaaggagctgagctcgatcgtacagaaattgtgaatgctgtgataaacaaccgcaaattcgtattcatcgtacgcttttttcaccttatcgatcagcttattcagcttgatcagcatatattgatccacttcgcggagatcttttacatccacggcattgatgcttggatcaaaatcgaacaggttgccgtgaaggaagcggaacgtgttgcggactttccggtatacttccgcgacctgcttcagaatatcttcagaaaccgggtgatcggcctgatagtttacggaagatacccataaacgcagaatttcagctccaagctgttttgcgatttttgtcgggtcaatcgtattgccgagtgatttactcattttacggccgtttgcatcaagtgtaaatccgtggcttaatacgcctttatacggcgctttgccggtgactgcaacagcggtggaaagagatgagttaaaccagccgcggtattggtcagagccttcaaggtataaatcagccggacggacaagatcatctcgttcttcaagaacggcctgatgggaagaacctgaatcaaaccatacatccataatgtcttgctctttcgtgaagattccgttcgggcttcccggatgtgtaaatccttccggcaggaggtcttttgcctctctttcaaaccatacgtttgagccgtgctgtttgaacagctcagacacgtgttcaatcgtttcgtcagtgatgatcggctcaccgttttctgcataaaataccgggatcggaacaccccagacgcgctgtcttgagatacaccagtcaccgcggtcgcgcaccatgttgtaaaggcgctgttcgccccactccggcacccacttcgtttgtttgatggcatcaagcagatcggatctgaaatctttaattgacgcaaaccattgcgcagtcgctctgaagatcgtcggttttttcgttctccagtcatgcggataggagtgtgtaataaactcgagtttcaaaagcgcgccgttttcttcaagcttctccgtgatcggtttattggctttatcgtaaaacattccttcaaagcccggcgcttcgtcggtcatgtttcctttttcatcaacagggcacagtacttctaagccgtacttttggccgacgataaagtcatcttccccgtggcccggggcagtatgaacacagcctgttccggcatcggttgtgacgtggtcaccgagcatgacgagtgaatctctgccgtacagcggatgttctgcagtgatgtattctaattctctgcctttatatgatgcgacaacttcaggattttcaaagccgcatgcctccgctacgttttcgatcagttcagccgccactacataacgcttgtctccaaccttgatgacattgtattcaagatcaggatgaacggaaattccgaggttggcaggcatcgtccacggcgtcgtcgtccagatgatgaagctttctccgttttccagaacgcctttaccgtctttcactttaaacgcaacataaatagacgcggaacgtttgtcctgatattcaatttccgcttctgctaaggcagattcacttgaaggcgaccagttgaccggcttcagacctttataaatatagcctcttttcgccatctcgccgaaaacgcggatctgctgcgcttcaaattcaggctgaagcgtaacatacgggttttcccaatcgcctctgacgccgagacgcttgaattgttcgcgctgtctttcgatctgctgccatgcataatcttcgcaaagcttgcggaaatcagcgacggacatttctttccggtttacttttttgtttttcgtcagcgccgtttcaatcggcagtccgtgcgtatcccagcccggcacgtacggtgcgttgtagccgctcattgatttatagcggacgatgaagtctttcaggattttgttcagggcatggcccatgtggatgtctccgtttgcataaggaggtccgtcatgcagcacgaatttcgggcggtctttcgtccgttcttgaacaagacggtaaatatcctgctcctcccagtctttttgcatgtccggctcacgattcggcagatttccccgcatcggaaaatctgttttcggcattaacagcgtatctttgtaatccattttcattcctccacaacatttttcagaaaataaaaaaagccctctcatcccataagggacgagaaagcttatctcgcggtaccacccttttagaaaaaacggatcatccgtcttttcctctcgaacatcgtaacgtgatggaacgtcctttcctactctaggttcagaaaggaaactaaagggctgatctgcatgattccggccatcccgggctttcaccttccccggttcgctttatagcctgttttgagtcatgccggtccctttcaatcgtcttttcatctgaatttatgaacgtattatattcgaacgggccgaagaatgtcaagaaaatcagaaaattattctttttcctcaaataccgcgtcgacttcgtattccagcagatgatcccaatcatcgttcttcagcaggtcgagctgcgcttcaatcagcatttggaaacgtgttctgaagactttagactgttttttcagctcttcgatttccattgcgatttttcttgatttggaaagcgactcattgatgatgcgatcggcatttttttctgcttcacggacgatcagcttcgcttctttctgcgagttgcgctttacgtcttctgctgcttcctgggctacgagaattgatttattcagcgtttcttcgatattggcaaagtggccgattttttcgtccagctcgttcactttcgcctcaagctccgtttttttacggagtgcgatttcgtaatcttttctgacctgcattaaaaattcatttacttcatcttcatcatatccgcgaaaaccttttgtaaacgttttgttatggatatcattcggcgttaatggcatattgccacctccatttttacatttcagtacggttatctagttcacattataaaacaaatacggcacagatggagaaaaaaactgaaaaaacgactcatttttgccgttcaaatgtaactttccatttgtcttttttcgtttttccgtcaacttttgccaaactgcatcgtccgaagccgcgaatcgagagcatgtccccttcagcaacctgataagacggatcttcaatagctttccaattcaccttaacgagcccgtttttcacaagcgcctgcgctttctgccgggattgcctgctcattgaagcgcagacggcgtcgagacgcaatgaagaaaccgtgtcatcccttatttcgacatctgaagcgggaatgtgaagagcggaaagctcgattttctcaagctttaccggcgctttgcccgccttggtcagctgagtgctgacaaaatcggcgatttcaccggagatgatgagctgcacggcttcctctgagaaaatcagatcgccgtatttctgccgctttaagccgatccccattaatgatccgagaagagagcggtggtcaatgctgacgaatttttcagcgtattgaacgtcaaaagcccggagctcaaaatcatcctgttcaggttccatatattcagggtataaaatcgcgcgtttgcgctcagctctgtcatatcctccgaaaaacgcaagaccgcaggcgtcgccgataacggcttttacaatcacctgttccctgggatctaagaaatcagtcagcttcatccgatactggtccaggacaatctgtttccattcaagcacctgatcaataaaaggccgctcgtcttgtctgaagtgctggtaaatatcgctcatgttctttcctttctatgtaaagaggcttggctggtgccaagcccgtatcaaactgtcgcattcaagtatacattgcgatcatgcggtataggccccaaagtcccgtcgtggcaaaccgaagcacgataatcgctacaatcggggatatatccagcatggcaatgggcggaatgatccttctgaacggctctaaatacggttcgcaaatcgctgcgagaaaccgtccgaccgccgtttctctcgtactcggcacccatgacataaagatatagatgatcagggcaaacgagtagatgtaaattaaataactcagaacggaaaaaatttgataaagaatcatcctgctttaccacctctgatgttcgtcttcatttataagctccgaaatcgtgccggaaacgtcgacattatcaggcgtgcacagaaaaatatctgaaccgattctctgaatgtcgccgccgatggcgtagacggtaccgcttaaaaagtcgacgattcttttcgcctgatcatgctggatgcgctgcagattgacgacaaccgcccgcctgttctttaaatgatcggcgatttcctgcgcttccgcatatacacgcggttcactcaagaccactttagaggatttctgaacactttgcaagcttactacgttctgcttgccctgcggcttctgagcgtaagcaggctgtttatctttctgctgttcatgctcttcctgatgatcctgctccgtttcaatgtattcgtactcgtactcctcctcatccattgagaaaaagtttttcagtttatttttcatgctcatttgtttacaccccccggttcatttccgactaatgaagagccgattctgataaaagttgcgccctcttcaacagcgatttcataatcatttgacatgcccattgacagttcccggcacggcgcgtttgtctgattcagtttttgcacctgatccctcagatcacgcaattgccggaagcaggctctgatcgtttctgtatcgtctgtcaggggagccatcgtcatcaggccctctacagaaatgtttctaaactcagaaagctctctgataaaggggatgacctcctctgttttcaaaccgtgcttagacggctcaagcgaagtattcacctgcacaaaacagcgaaccgtatgctgcgcccgtttttcaatctcttttgccaatgacagtctgtctaaggaatgaatataagatacacggtcaacgacggccttcacctttctggactgaagactgccgataaagtgccacttcgggcttcctttgatgacttcctgcttatggataagctcggcatcccggttttctcccagacttgtaataccggcatcaacggcctcttgagccctttcagctgatacgtattttgtaaccgcgatgacggtaacatcttcggggcttcggcccgatctgttacatgcttcgtttattctttcgtttatatgtcgtaattgatcagcaacacgcaagatctaatgcctccttcattccgataaaggacatcatgcgtcccgttttccctttgtcgcggcggtgtgaaaagaatagttcatgctctcgttcggtgcataatccgctgactgaaatgttttcttccggaatgccgcaatgtatcagaagaagacggttgacctcttttaaatcaagctgatactggcctttttccgtttcgcatatggcggattcagccgtaaagggcagcgcccgcacttcattgatgacgcggtcgtcgactgtatagcttcccgcgctgatggacggaccgatgacagcctgaatatctgttaagcgggagccttcttcgtttacccagcgttccgtcatgatgcgtccgatttgtttgaccgtccccttccatccggcatgggcagcgccgataatggatttcaccgggtcataaaaatacaagggcacacagtccgcaaaacaaagggccaaaaaaagattcgcatctttcgtgtagagcccgtccgtcccgcggaatgcggaagaatagtctctcgctccttttcctttatccccggctgtcacgcgccggacgcggttttcatgtgtctggtcggcgaacacccaggaatccagatcagtaccgcataaggacgctatgacttcacggtttgtcacaacatcatgagcttcgtcccggacgtgcaacccggtatttaatgactcatacggaggattgctgacaccgccgtttttcgttgtgaatccggcgatgacctttgtgttaagctgattcacacagttccagtcttctatcatgagtgccgagggggtggtaagactaaacgggtgatatgtattcatggagatccaacctttcgacaaacattaaaaaagcgtaatttcccactcattttaacacaattttaagcatacgtttagcggctgattgaaaaatgagataaataaatgtgccggaaacattgagatttccggctttttacaagtaaagggaggattacgctcccccctttggttcatttacacgcactaagatgacatcttccccaattttaactatatttcgccaaggaatgatcatttcctcttcttttccgaaaaaaccgagaacttttccgctgccgcctaaaataatcgcctgaatttttcccgttgtcacgttaatatcaatatccccgatgcttccgagtttttttccgttcgacacgtttaccacatcttttatttgaaattcagatatgctgatcatccgtatcacgccctttgcccgttctttttcctattatatgaacggccgggctgaaccttgtcacatcgggcaatcttttttgcggctgcaccagccgagaataaatctcagcatgattttcgtatagtccataagctcatcaacggacacttcctcgtttacggagtgggcgttttttaaatcgccggggccgtatatgacgctcggaatcccggcctgataaagccatcctccgtctgttacggtttgggaaacatcaatgacgggctcctgttttatgacggcagagtgtgatgcagccaagacagaaactgccggatgatccggatcgatttccagcgccgggaacacctctcctctgtcttcaatcatcgaagatccgccccatttgaacaccggcctgttttctttgagccacagatcactgtcagcgacacgattaatatagtcttcgatttctgcggctgcttgttcgtgcgtttcgttcggataaaagtggacggtgatccataaccggcattcatcggcgacaaacgctgcgtgtcttccgccttcaatgacggcggggttgatcgtattggtgccgggcgcaatgccgggatagcttttcgttaccgcccagtggcgctccagctctcccaaggcagtgatgattttcgccattttttcgatggcgctcgctccgaatgtgcctccgcccgcatgaatcatattgcgcctcatgccgtcatgaaatgtttgtttgcttttcaattctatccagccggtgatgacaccgccctgcccttgaatatgcaggctgctcgtatccgcgacaaccgcaaaatccgcgtgatagccgcgtttgcagcattccagcgtccccgcctcgccgacttcttctccgattacagactgtacaatgaggtcgcccggaagcttaatgccggcatcatggatcagcttcagagagaaaagaacacacgccaacccccctttcatatcagcggcgccccttccgatcagcatgccgtcttttacgagcggctgaaacgggtcagagttccaatcttcgcccccggcttctgccacatcaatgtgtccgtttaaaatcaggctttgatgcctgcttgaatctgtcccttttaaaacaccgactacattcggatcttccggatacacatcccacatatcgaccgagcagcccgtttcttttaaaaagccggccacccacttttgggcttctgccgtatttcttgctggcggggccggagtgggaaaggcgatcaacctttcagcaatatgtatgaagtcgtgcctccgtttctccgcctgttgtaacagcatatcaatctgatgcattggaaatctcccctttagctgtatcaaaaaacccgtttcattaaaatgaaacgggtaaaaaacggatcttcctccgcttttttcaccgcttccctccgccggcatgatccggatcaggtccgttaagggttgagacaacgtctctctcagccgcatggcagcacccccagggtgaattgatgttattttacggttgatgcctcttttgcacgtgttaaaaacgggcggccattgttccataagacattgacaggcgtatcgaaaaacgctgtaagccgctcgtcagaaagcatatccctgattttcccggaggcgaacacctcgccttgttttaaaagcagcgccttatcaaataccggcagaatttcttcagcgtgatgggtgacataaaggatggacggcgcattttctttttcggcgatcgacgtaatcgtgtccagcagctgctcccttgccataaaatcaagacccgtcacgggctcgtccaaaatcagcagtttgggatcagccataagcgcccgcgcaatcagcgctctttgtctttccccttgtgataatgtttcataccgcctgtcggcgtaactgatggcgcccaaatccttcagaagaccgatcgctttttcccttacctgctcactcggagtttcgtacagcccgattgaggcgtacgcgccgctgagggcgatttcaaaagcggagtccgcggcatataatttgtgctgaagacctgccgaaacaaggccgattttccttctgagcctgtcaccgagctctgttttgccgaactgatggccgagcacctgcatctctcctgaagtggggaagtaataagagcataacatattcagcaaagccgtttttccggctccgtttaatccgtacagcacccaattttcgtttttctcgacgcgccagttaatatctttcaaaatccatttcccgtttctttttaatgacacactgtccagctgtaaaatcattgccgtttcccccgtttactttatttaaattttctaaaaacttttacacattagaatacatcacttttttgcaaacgtaaaccatcgcatgaaaaaagcctttaaacaaggttaaaggctttttccgttattgatggatatttttattcatttgtttaatggctgccttttcaagccttgagacctgagcttgggatatcccgatttcttcagcgacttccatttgggttttcccttggaaaaagcgctttcgcaaaatcattttttcccgttcgttcagtcttctcatgccttctttcagagcgagctcctcaatccattgtgtatccttattgcgctcatcgctgatctggtccatcacgtagatcggatcgccgccgtcattataaatcggctcaaacagtgaaaccggatcctggatggcgtcaagggcaaacacaatttcttcatggggcacttcaagaactttggcgatttcctctgctgtcggctccctgcttgtctcactgattaaccgctctcttacttgaagcgctttatatgcgatatcgcgaagcgacctcgagacgcggatcggattgttatcccgcaaatatctgcggatttctccgatgatcatcggtacagcgtatgttgaaaacttaacattatggcttaggtcaaaattatcaatggatttcattagtccgatgcagccgacctgaaataagtcatcaacatactctcctctgttgttaaacctctgaatgacgcttaagacaaggcgcagattgccgtttacaagcttttccctcgctgaatcatcgccctcatcctgcaattgcctaaacagctttctcatctcttcattcttgagcaccggtaatttggaggtatccaccccgcaaatttcgactttatttcttgacacgtttttccctcccactaggagctgctgtacaacgttaagtatctcctcgggtgggaaaaatatgcaccgctattttacagaaataaacatccggcggcggcaatccttgcagcagtaagggctgtcagatggaaaaaattttacaccattttgttaaactcttttctcagtcttttgataatccgcttttcgagccgggagatataagattgtgaaatccccatcatgtcggctacatctttttgggttttttcttcttctccgacaagcccgaaacgcagttccataatctgcttttctctttcgtttaattgctcaagcgcttttttcaaaagttttttatccacattggcttcaatgtctttcgtaataatatcatcatctgtgccgagcacatccgaaagcagcagttcgtttccgtcccaatcaatgttcagcggttcatcaaaggacacctctgaacggattttattgtttcggcgcaagtacattaaaatttcgttttcaatacatcgcgatgcgtaggtggcgagtttgattttcttttccggattaaacgtgtttaccgctttgatcaaaccgatggtgccgatgctgattaagtcctcgatattgatgccggtgttttcgaatttgcgggcaatgtaaacgacaagacgtaagtttctctcaatcaggatggcccgcgccgcctgatccccgctcggcagctttaataagagcacctgctcctcttctttagacaaaggcggcggcagcgcctcgcttcctcctatgtaatacacttcatcgcttttcagcccgagtttcatcagccatttataccacaaatatgtcagacgcagcttaagttttttcatcttcctcccccttctaaataccacgcgttttgagtatgatgaataacagacttttcgtcaggaaacatgttttacagccttccctgtcagcatcttcggatgaacgattccgtcaaattcaccgtcagcggataatggcttcgtgctgatgccgatcaggcatttttcacatgcgatcatctcgtcttttgttaaaatcgtgacgtaatccggctttaaacagagtaaaaattgattgtcctggccgacgcccctgtatggaatcagcctcagcttatccgcatgacggaacgaatcatcaagctgctctatcacttcaagcggactggcggatttgatgaggtccgtttccttttcgctgagaatcggagcgaatttgtcaatgtgaaggatcatgaccggcgttttcgtcagcggatcatacagctgattcccggaatccaccaatcctttcgcgcggattgtctgtccgctgaattccgcctgcaccatgacaagttcatcgtactgaatggacttcgtctcgatgtcttcaattctctttttcgaaaaaaaccatatggccggaaatccgataactacaaacatccagctgatcgggtcgccgaatccggtctggcttgtaaccattacgccttgctgcacaattgattctgtctgcagcagggaatgtacgccgatcattcccccgccgacgagaaaagtcgcgaaataaaaggcgaacaaattttgaaaaaagtatcggaaccgtttaaagccaaaagccgtaagcacgatgactaccgaaaacgccatttttcccgccggatgctccacaaagggagaaacaggcgtaaacatcagaagcacaatggctgacccgatgaaaccgccggcggccactcttctttttttcacctggcgttttaaaataaaggcggtcaataaaagcaaaagagaatcaaaacaaaagttcaacagccaaatgacatccagatagattttcacatctgacccctttcctcttttgtcttacatatctgtttctctctcttgtttcataagtataaagcaagctctgtgggaaagtctgtcaattaatgttgagggtaaagtacaatttttaagggataaccgttttatttgtcgagggccgaaaaggttgattttctattgtccccttcaactaaaaaagcgctgccgtgatttggcagcgctctgtttttactcattgatataaagttttcctttagccgtctgtctcgtttcatttccgtagtcatctcttgcgataacgtcaatttttgctccgcttgctttgatgaaagaagccgccgtccagtaaccctcatatcgtcccggagaaatttctctcagcggaagctctgttgcgttttggctccctgcccgggcgtttgtcagaggcagacggatcacgaaggaagcgtctaatttctttccgcttgaaaaagcgattttcactgattctccggcttttaattccttatccgctccgggaaccaatccggaaatgacgggagcattgtaattgacatcgattaccgtctttttcgttgttttgttacccgctttatctgaggccgtgaccttgatctcattgctgccgttttccagaagggttctcgcttgataagaaccgttatttacttcagctttttttccgttcacctttacccattttaaatgggcgtcgtgcacttttccttttacagtcactgcttctttatttgttttatcaccgtttgccggactgtcaatcgtcacatcaggcttatcctcatccagtatgaccgtgacagggcgtgactcatcggttgacccgctgtctgtcacagatgccgctgtcagccgattgccatcttgagtgagtgtgacaccggcctggaaactgccgtctgcatctgcttttgtttctgcggcggttttaccgttattggtaagacggacagcggtttttggtgaagccgttcctttcactgtgattgacttcttgtttgtaaatgaccggtcttcaggcgacgttatctcaggcacagaagcttcgtagtcgaccaaagccctgatcataaagtttccgtctgttttatcggcttttgaccagcggccgtcgaggtattgccagtttctgttcgagtacgggctgccgtcatcagatgacagggcaggtgtataaggatcgggtttcgtctgacggaacacaagataaaaatcctttccgaccgcgattccttttgagctgagatccactttggtccactcgccgtttcgaagcgcttcagcttggaacgggccggcaattttgctgcccggagctccatcagggccggatgcatcatatacttctgcttgaaattcggtaccgcccggatcaggccagtcggcgccccaaaatttaaaaaggcctcccgtcagcataccgtgttcttttccgtctttgagggtcatcttaacggcagatttgctgccggctttaaaatatgacagcgcggcttcttccgtcccgttatcataggcgatttccccttcataaccgacatacggcttaagcttgacgtttttttcagcatctcctttgatgtcgacagaaaattcgctattgtaaaagccttttgccgctactttgattgtgtaggagccttcatacgccttaagcgaatattcccctttatcgtttgtcaccgccggctcaattgcggcatcctcggccacataaagcgcagccccttttaccggttcgcctgtggactgattggtgatggttccttttagcgtgccggacggcatttgctccagtgtaaagtctgcctgtgcggttttgtctgattgaatagaaacttgtttcgaagcggacttaaatccgtaagcctcggctttcagcgtatagcttcccgccttatgtgacaggctgtagcttccgcttgcagggtcggaatatacggatttccccgtctcggcgacactgatttgcgctctgagcggcaggaggtttgtttcacgtttcactctttttccgggtgatctcactgccggtttggcctgtttcggactgatggcttttttcttcaggtggccgggaggtgtttgtctattgtgtttactttttttagccgccttgccgagagggctgcttgaaagccggacatcatcgatataccatccgtcttcattgagtacttcgtcagactgcatattaaacatgagctttatgttttggcctttatacgcagataaatccgcctcttcatcattccatcctgcggaatcaccattgtaaacggccgcctgctcccaatttgatttcccttccggcagaacgaacacatacccgtaatcaaaaaattcttcgagcttgtgccagcttttaaattgtaaaaacagccgccctgtttccggaacttgaatcggaggcatcacgagattcatgttggccgaatcggcataagggccggacagattcgtcgcatacactttatctccggaaaatgcggcgccgggccctgaacccgggataccccattcccattgatcatgtgtcccgtaactggaccagcccgccggctgtgattcaaaatcctctttgtatcccgccgtaatgctcggtttcacgtcagcccggtacgtatcagattctacagaatgacctccgaaatcttttatggtccatttataacttatcttgcttcccgttatgtccggaatctccgcctggtatgttccctttttttcatcaccgcttttttgaacggcggctgtcgttttccactctccttcatcaaactgataggagaggatcacctcagttatgcttacatcatcttctgctgtaaccgttaacggaaggtttgcccctttgtaagcctctgagaccggttcatgatgaaagctgggcggattgtgatcttcacccgcagaagataccttgccttctacgcttccgattccgtccgttacggcagaaacggcatcaaaagcgttaacgaggccgtggccgtaaccgttattcggtgattccggaaaaacggagtctgtcagcttttcggcggtgcgcgtcagaacgtcttccatttcatcgaccgtaatagaggcgttcgcctgccttaacaaagccgccgtcgccgccacatgcggcccggccattgaagttccgtcccagccgccttcgtatgttcctccaggaatagaagaacggatattcacgcccggagccgaaatgtccggttttgtttcatgatacggtgaggggccttgaagtgagaaatcagcgagtttcttgtcgatgtcagtcgcacctgtcgcaaatgcttcaggataattggccggatttgcgattgaacccggtcctcccggtgtaaataagtcttcatttcccgcagagaattccggaaaaatccctgccgctctccacgcattcaccatatcgcggtaccactcgtccattcccgaaccgcccgcccaggaattattgacaacatccggcgccatctcgggatgcggcgtgccgtttttatctttaggcgcaagcacccattcaccggcatccaaaatatcggcatcggttcctccgtcatctgaaaatgcttttactgcgatccatttcgcccccggagccacaccgatttgatttgagccgtcaggttctgaacccgtcatggtccctgttacatgagtgccgtgttcaagatcgtcgtagggagcgtctttatgggacacggcatcataccagttcatttcatgattcggcgctgcgggattttcaggatcgtaaccccggtatttttccttaagcgcgggatgatcccactgaactcccgtatcaatggaggcgacaaccgtgccggttccgtcgtatcctgaggcccaggcctgcggcgcatcaatttggctgatattccattcgatgccttcctttgctttgacctctttttgttttttcttcatttgaaaaggagcttttgcttgccgttgagtaagctgacgtttttcattcggaagaactttttctacttcaggaaatgaggcggctttttccattacctctttcgaagcagtaactgccattccgttgacaatataataggaatggatgtgatcagcctttcctttctttttttgtttttccaaatatgttttcagattctgctgcgcatcatgagctgccagttttaaagaagaaacaacggctgaccgcttttgatattcggtttttgctgcggaaagcgaatgagactcggcatttttttctgcttctttgaccgcttttttcgtattggctttctctttaaatttgataagaaacgtgactttatcatttttttcaaaacgcttcttgactgaatcggaaatcttatgctgaatgctcttagaggaagaaagatctttggtgaaagaaactgcccccggtgtgctgttcgctccggctgcacccggaaacaacagtgaactgacgacaatcgcacttaaaacggagcctgtccatctgtttctcgtttttttcttcaatcgtatccccccttatttggtaacgccctataaaatgtgtatccccccttcataattggaatcgtttgtcatttcgatgctgtacgttaaatgtagacaatcttccatccagatattgtcacattctgtagaaagccgtatgaaactaaaaaacaatcaattcgtcataggtataaagcttcttttttcactgtatagatcatgggggataggaaggaagactgtgcacaaaaaagaaaaaggacaaaaccatgtggtcttgtccttttttacatcagccgcgtttgttgcggtttcttaaaaatgtaggaatgtcgagggcatcatccgccggttgtgatgtatggcggttcaccgtgttttgatgctgtgtttcttctcgtttcggctcacgtttcgcagcgttttggctttgagacttcaatccttggtttaaagtcggacgctgcggttttgagtcatctttttcctgttcgataaaaccggtcgcaataacggtgacgacgatttcatctttcagattttcattgataactgaaccgaaaatcatattgacatcagggtcagaggcagaagcgacgatgtcggctgcttcctgcacttcgtagaggctcaggtttgtacctcccgtaatgttcatcaaaacaccttgcgctccgtcgattgccgcttccagtaacggactggagatcgcctttttggcggcttcagcagcacggctttctcctgtagcgatcccgatacccatcaatgctgaacctttgttggacatgatggttttgacatcggcaaagtccaagttgattaaaccaggcgttgcgatgagatcagagataccttgcaccccttggcgaagcacgttatcagcttcacggaatgcttcaagcatcggtgtgtttttatcgacaatttcaagaatgcggtcattcggaataacgatcagtgtgtcaacggcttctttcattgccgtgataccgcctgcagcctgcagctggcgttttcttccttcaaatgtaaacggtcttgttacgacaccgacagtcaaagcgcctaagtcctttgcgatttgagcgatcaccggtgcggctcccgttccggtaccgcctcccattccggctgtaacgaacaccatgtcagcgccttttaacgcttcttcgatttgttccttactttcttcagcggcttttttgccgacttccggattcgctcccgctccgagaccgcgggtcagcttttccccgatctgcattttcacttccgcttttgacaggttaagagcttgcgcgtccgtgtttaccgcaatatactctacaccctgcacttcattttcaatcattcggttgaccgcgttattaccgccgcctcctactccgattactttaattgatgctaagccgtctatgtttgtttcgaaatccaacatgctaaatcctcctaatctgccgaatgactatcaatctattcccaaaacatgcttaatagttttttcattttgctcggtttgttgtgttcggcttgtgttttttgttttgcttttggacgctgctgcgcctctggccgctgatgatgttcttcttcgtgagagaccgcgatttcctgcacggcttcttccggcatatgaaagcctatttttcttccctgaattctggcatttcggcaggcaaattgtatcaagccgacacccgtcatatactgagggtctcttacaccgatgtaattcgggcttgcgacccttacattgtgcctcagcacttcctgtgccaatgaaagcactccgggcattgcggcctgtccgccggtcagcacaaagccgccgggcagatctgtaattcccatatgctcaatttcggctgcggcaatctcaagaatctcttccactcttgcttcaataatattggcaatttcctgctgtgtaaaagattgcttttgattcgttcctatgacggtgacttcaaatacttcatcttctgaagcctcatcgtagaatgcatgtccgaattgtttttttactctttcagcctcttcggtggaagtgcgcaatccgatcgatacatctttcgtgatgttttcgcctccgagcggaatgacggctgtctccttcaggtgcccctgttcaaataccgccaccgtcgtcgagccgccgccgatatcaatcatggcgactccgaggtttttttcgtcttttgacaaagccgccgaaccggccgcaagcggctgcaggcagatatcagtaatttcaacgcccgctctctccacacagcgaagtaaattatgtaagatcgttttggagccggtaatcagcgtgccttctacttccaggcgcactccgagcatttttttcggatcggtaatttcgtctcttccgtcaacgataaactgtttcggaacgacgtcaacgatcagctgctcatgcggaaccgacacgacctgtgccgcttccattaccctgcggacgtcttcaacgtgaatttctttgttttcactggaaacagcgacaacgccgttcgtatcttgaatatgaatataatttccattaacgccgacaatggcttttttcagcggaaaacctaccattctttcagcttggtcaaacgcttttcttatagaatgaacggtttcatctatatcaacgattgagccttttttcaacccttcagacggtacatttcccactccgataatgttaagggaatcatctgtcatttctccgacgatcacttttgtattggacgtaccgatgtcaagactgacgtaaagttcattgttgttcattctatggcacctcctcacatttcgatcaaattctattctattatttgcggaacaacaatacaatgaatgtggctttacaagtgtgtaacaaaaacaacagcatcaacaaattcttatctgatttctcacaatttatgtttaatgaaactattcgttatattctatgtatatcctcttttatatcgcattttttttattttttttagagacggcccaccttaccgtaagatttcctgtcacggtgccataatgtgcaaaccagatgcaaatatacccgctttccattagtctacactaagatgaacctccagaaaagctatagatattgccagaaacatccgaaaaaagaagaaacaggaggaaaattccaaatgcaatgttcattgaagaagacacgcccattgcattgagaattttccccttgtccggcagccatatcccgggcaaaaacaaacatagtcataattattccgctatcggttatatcggctgccccgctgattgtaatagattcttttgaatcaccttaaaattagttctttagaactattaatcattttcttttttcttgccggatttacctttgttaaattcttcaaaatacgtagcgacttctaagtggataatcccctttttcccgccgtccagctgggaaacgatagaaggataggtcttcatccggtcggcaaatgttttaatagaagcggtaactacatacccgtcgttcatatacagcttgatccggtcctggtccatttttaccggtgtataatagatttcagaaatcgactgctttagcgaaccggaaagcttatcaagctgctccgccattttgacccgctttttcgcgtttgtccagtcaaccaaaatcgggcccgcgtcatccggcgtgacttcgttcggcagcacggtgccgttctccagcacttcataatacacatcattccgctgcagatacgcgatcgtcttgtattcttcaatgtgaatgctgactttattaggaaatacttttgaaagatccgcctttttcaccagtttattctgctcaatcttttcttctgtttttttcttgttcagactccagaactcggtttgtccgttatgtatatcagaaagcgcgttgatctcttttacagacacgttttcgtttccggaaacggtgacagaagacactttgctgatcggcatctgcaagtacacgatgatcagcaccatcataaaaaagagcacaatgaatgaaatcagccggcggtttgctttttgtttccgctgctctttgattttcggaatccgctcttcaatatttacgattttttctctttcatgatttgggttcactgcctgtccacctcactaagaatgaaacagcttgacattcgtctgattgaaaaacaaacggcatgctgtgatgccgtttgacatttgttaaaagtatatcacatgagctcatggaaatcagagaaccttttaacgattccctccgatgatttcaacttccgtatgcatgtcaacatcatactgctcacggattgtctttttcacatactcaatcaggtcgagaacgtccttggcagtcgctccgccggcattgacgataaaattcccgtgcatttcggatactttcgctccgccgatctgatgtccttttaatcccgctttttcaacgaggtttccggcatgattcggcagcggatttctgaatatgcttccggcgcatgggcttgaatacggctgcgtattttttctgtaatctttgttctgctgcatttgcgccgtaatggcttcccgttccttttgctcaagctgaagaactgcctcgagacagacgccggggcgttttttctgcaaaacagacgttctgtagctgaaatccatctcttcgtttgtcagccattcgattgtgccgtcttcaaataagatacgcgctttcacaagaatttcactcatatcagatccgtgcgccccggcattcatatagacggccccgccgattgatccggggatgcccgctgcaaattcgagaccggacattccttttttactcatggaagtcgcaagccggacgaccgaatagccgcctccgaccgtcacctgatcaccgtcaatctccaaatgatccagacccgcgcccagtttgatgacaactcctcttatgccttcatcaagcacgagcagatttgaaccgcggccgataaccgtccatggcagatcatgtttcttcacaatatccataatatctttgaccgcttccacacggttggggatgatcaaaatgtccgccggaccgccgattttcatcgttgtatggttcgcgagcggttcttgttccagcactttgccgacttcgcggtctcttaattcctgaattacgttctccatcataaacctccgcattccatttgctctatttttttatgtcttccatgatactgtacagtctggctgccgcatccggaacaccgagtgattttgtccgctcactcatgtcttttaaggtttcttcattcatgacgattttgtccagcgcagcgatcagtttttctccgctgagctcggtttccttcagtacgattgcagcgtcatgctggctgagcgccttcgcattgacttcctggtgattggctgtcacatacgggctcggaataagcacgctcggaatgccgagagcggtgatctccgcaatcgtcgtcgctccggctcttgccacaatgacatcaattgattgtaagtactccggcatttggtgcaaaaacggttttgtcaccatattatcagcggcttttccgcctttcagctcagccgttaccttctcgtaatgcacttccccggtaatataaagcacttggtaaggtctcgttttcaattcttcctgcatatctatcacggcacggttaatgggagccgcgcctctgcttccgccgaaaatgagcaccgttttttgattgtctttcagcccgaactcagttaatgagcggcctgtcttaattgagacgacttcagaggctctcgggtttcccgtaaacacaactttttcagcaggaaaatgcgattttgcttcttcaaagcaaattgccaccttattaacatatttcgagagaaacttatttgtgatgccgggcaggctgttttgctcatgaatgatcgtcggaattcccatttttgccgccgcgtatacgaccggaccgcatacatagccgcctgtaccgataacggcatccggtttaaactcttttaaatatgatttgcttttcttcacgccttttaagaaacgcatgacggtttttacattttcaaaagaaagttttcgtttgaaacctgtaatttcaatggcgcggaacgggatattttcccgttcaacaatttttttctccagaccgttctctgttccgatatacaaaaattccacatccggatgccggcgctgaacttctttaataaaggccagggccggataaatatgtcctccggttccgcctccgcttactgcaatacgcattcgtatgtcccccttaatcacatagcgataaccctgttttttaggacagggttattgatgttgtctgtttttttatagataacgtatagatcatgagtgatgaggcaagatacagatcaatacctcgagtaccggctgacatttaaaagcacgccgaccgctgcgagcatcagcgtcagtgatgagcctccgtagcttaaaaacggcagcgtaattcctgttaccgggatcagccccgtcacaacgccgatattaatcatgacttgaatagctatcatagaaataataccgatggcgacaaagcttccgtataaatccggcgcgccgagggcaatcctgacgccccgccacaataaaatactgaacagcagcaatatgagcgaaccgccgataaagccgagttcctcagataaaatagcaaaaatgaaatcggtttgcggctccggcaggtaaaaaaacttttgccggctttgaccgagccccatcccgaacagtccccccggacctacggcatagagcgactgaatgatctgaaatccgcttccaagcgggtcctcccacgggtttaagtaagaggtaatccgtttaatccgataaggagcggacagaacaagcgccgcaaatccgcttaaaccgatgagtccgaggaacgcaaaatgagcgattcgcgcaccggatacaaaaatcatcacgatgcacgtgcccaccattaccgtccccgttcccagatccggctggcacataataataataaatgcagaaaacacgattccgagcgcgggaacgaatccgcgtctgaatgacgtaatattcttctgtttttcagaaagaaatttagccagaaacgcaatcatcgcgagtttcataaactccgaaggctgaatgctgaacgctcccactccgatccagcttcttgaaccgttccgcaccattccgactcccggaatcagcacaagcacaagcagaaaaaaacaaatgatcagaagcagcttcgaccatgtgcgccatgtccaataatccacattcataatgaaaaacatggcaatgacgccgatccccgcaaacagcagctgccgtttcgcgaagaaaaacgagtcgtcaaatttataatccgcccataccgcacttgcactgtagaccataattaatcctattgttaaaagcaataacgtaatgataactaataacaaatcaggcgctgtttttttagtagtcaatgcaatcgacaccccaagcataagtcatttagggctgccgatgaacagagacaagcccttacttaagcatatgcacggcatctataaacatgtcaccgcgttcttcaaatgttttgaactgatcccagcttgcacacgcgggtgacaagaggatgacgtctccttcatttgagagcgcaaacgccgcagatactgcttgttcaacattatcgacacgtttgacatgttgtattcccagctcattgcccagtttttctatcttcggcgctgtctgtccgaacgtcaggaccgctttgacattgtccatatacggtttcagatcgtcaaaaccgttgccgcggtcaagtccgcctgcaagcagaataaccggtgctttgaacgcggagagcgctttgcttgtggccaaaatattcgtcgctttgctgtcattataaaatttacgattccggattgctgttacatactgcagacggtgtttgacaccggtaaagcttgtcagcaccttctgaatcgctttattagacgcgcccgccgtttttgccgcggctacagctgccaatatattttctaaattgtgcgcgcccggcagcacgatgtcatcaacaggcagaatcgcttcatcgccgaacatcagcattccgtctttaataaatgcgccgcttgacagttcctggtgcactgaaaacggaacggtgccggcttttccgctttcggcaagccgcacgactgtttcatcgctttgattcacgatggccgtatcactctcaagctgatgaagatacacgttctgcttggctttttcatagttttcacggctgtgatggtaatccaaatgagcgtcgaacacatttaaaatcaagccgatttcaggtctgaacgcatgagtccccataagctggaacgaagaaagctctgtgacgatccattcatcaccgtcagcatgataagccacttcactggcgacagtgccgatatttcctgcgatcagcgcctttatcgagtcagctttcagcatttcataaatcagggtcgtcgttgttgttttcccgtttgaacctgtaatgccgatgaattttgcattggtgatataatacgcaagctcgatttccgtccaaaccgggatgcctcttctttgcgcttcctccaccatgatattttcatacgggattccgggatttttgatcagaatggtaatgtgatgctgatcaaaaagtgacgtcggatgctcaccgcagatgacctcgattcctctttctgaaagcctttgggcaggttcgttctcttcaaaggctttttgatcattcacgacgacgttaatgcctttttcatgaagaatcgacgcagccgcatatccgcttttcgccagtccgaggaccagaaagttttgttttcgcaaaaaaagttcgttttccacttataaccacacctcgatgtaaattcctaaaacggcaagcagcagtcccgcagtccagaatgtgacgacaactctccattcagaccatccgaccaattcgtaatggtggtgaagcggactcatcttaaagattcgttttcctgtcgttttaaagctgatgacttgtaagataacagataaggtctcaataacaaaaactccgccgataatgacgagcagaatttcaagcttcgtcagaatggcaacggtcacgatcgctcctccgagcgcaagcgaaccggtatcccccataaatactttggcgggatgggcgttgaatacaagaaaaccgagaacggcgccgacaacggcaaccgagaaaatcgcaacgtcatattgtgactggttccacgcaaggatggcgaaagcgccgaatgcgatagccgcggtaccggacaagagaccgtccagaccgtctgtcaggttgacggcatttgaacctccgacaagcataaagagaacgaggataaagtatccccagccgagatcgattgacagatgtgtgcccggcaccctgatgccggttgaaaaatggcaataatgatatactccgtaaaatacaatggcaataatgatctggccgatcaatttctgcttcgacgtcaatccgagattccgtttcattactactttaatatagtcatccagaaagccgagcaggccgtatccgatcgtaacaaacagcagaagaaacatttccgcgctcagatgcgaaaatttctgcgtcatgacaatcgccgtaatggcgatggatacgataatcatgaccccgcccatcgtcggcgtccctgattttttcatatgtgatttcggcccctcttccctgatactttggccgaattttaaacgtcttaaaaacgggataagaatcggagatatcagaacactgattaaaaatcccattattattgtaaataaaatcacttgctcaagcattgctcttttctcctcccgtttcgttcaaacgacatacgtatttatcatattcacattgtgtccccgtaattcttttcatttcactcattctaacactctttcctgttttactttttattcagctcaacaatagctcttcccgctacttcggcgtcatcaaagtcgaatgtttcattgccgatctgctgataggtttcatgccctttcccggcaatcagaaccacatctccctttttcgcgttggcaatagcaaaaaagatagcctgctcgcggtttgcgatactgtgatagtaggtgccttctacccctctttccatatctcttaatatggccagcgggtcctcgcttctcgggttatctgaagtgaaaatcggttcgtcggcaatccgcaccgcaatttccgccattttcgggcgtttcgttttatcccggtctccgccgcagccgacgacgacgaaaagcttgccctctgtcatgtctttgcatgtattcagaacgttttccagactgtcaggcgtgtgcgcgtaatcgacgaccacaggaaacggctgattatgattcaccagttcaaaccggcctctgacaccttgcagctcttcaagagcgctcgtgatcgtatcaaacggcagacccgctgcgatcgctgtcgccgctgcagccagtacgttatacacgttgaagcggccgacgagtgaaaccgtgatctgctttgttcctttcggcgtaacgagttcaaaacttgtgccttgcgcagagatctcgatttgtttcgccatgacatcggcatcgttctcgattccgtatgtaaggatgtgcgccgccgtcactttttcaaaataagcactggctttgtcatctgcgtttaaaacggcccgcttcggcttttcatggttaaaggagccgcccagctgggaaaacaggaggcttttagcctgtctgtagtcttccatcgtcttgtgatagtctaaatggtcctgcgtcaggttcgtgaatacggcgatatcataatcgcagccgtgaaccctgccgagtgacagagcgtgagatgacacttccataatagctgtgtcaacatgctcatcattcattttcttgaacgttttttgcagtgtgacgctttcgggcgttgtatttttgaccgggaatgtctcatccccgattttaatgtacatcgttccgattaaaccggtctgtcttcccgcttttttgaaaatctcatcaaccatgtgcgtcgttgatgttttgccgtttgtgccggtgatgccgataagctgaagctgctttgtcggctgcccgtaaaacgcgtcagaaagaacgctgagcgcccgctgtgaccggcggacgataatgacaggaacatcgacgtcaagctctttctcggcaacgatggccgctgcgccgttttctgcggctttttgggcgaaatcatgtccgtctaccgtatacccttttatacacacaaaaagactcccttttctcacttccctggagtccatctcaattgaagttatgtcagggtcatgaaagtcattttgaacaggttcggccattaaatatgtaagcagctttgtaagtttcattgtatcaaacctctcagaaattctattcattcttttatcatgataaccgtttataaaagtcagaatggcttttaaacatacagttcatattttagcgtaaataaaaggatacatccagttaatcttaaaagttatcttctttttttctctttatgataaaaggcagccgaaaacaatcggctgcctcaaaaagactcattcttcactcaagtaaacacggatctttgagccttcttttactttcgttccggctgcaggtgattgtttcacaattttgcttccttttcctgaggagtcaatattcaaattgacaagcagcgactcaagatcagagacagacatccctacaacattcggaacctctattgtttttgtgtcgttccattgatattttttctcgatttgattttttcgcggtttcacgccgagctccggcagactgtctctcatcatatttccgacaatcggcgcggcgacggttcccccgaattgaatcgtgcctttcggattatcaaccgcgacatacacgacgaggctcgggtcatcagccggcgcaaaaccgataaaggagacgatatggttgttttcgagatatttgccgtctttgaccttttgtgcggtacctgtttttccgccgacgcgatatccttccacgaaggcattccgccccgttccctgagcgacgacgctttctaaagcatatctgatctgctttgacgtttcctgggaaataacttgccttttcgcaatcggcgattgtttcttaacagtttttttcgtaacgggatcaacccactctttggcgataaacggagtataaagcgttccgccgtttattgctgctgaaacggctgccacctgctgaatcggcgtgacggaaaccccttgtccgaaagcggttgtcgcctgttcgaccgggccgactctgtcaagcgggaataaaatccccgttccttccccttgcagatcaatgcctgttttctttccaaagccgaagtccttaatatattgaaacagcttttgttttccgagtcgttcccccagctgtacaaacccggggttgcaggaattttgaacgacttcaagataagattgcgaaccgtggccgccctttttccagcatcggaggcgggcgccgtcaacctcggcaaatcctttgtcataaaagtggtctctttgcaagtttactttttgctcttggagagccgctgcaagcgtaataatcttaaaggtcgaacccggttcatatgtgctccataccggcaggttccggttgtaaacggacggatccaccgattgatagtcagccggatcaaaatcaggacggcttgacatgccgagcacttccccgtttttcggattcattgcgaccgcaatcattccgtccgggttatatttcgccgctgcattgtcgagctctctttctataatcgtctgaaccttggcgtcaatcgtcaatttcatatcaagtccgtctttcggaggggtgtaatcatccgcttcatcaggcattttcttccccttggcatccgtataaaatttcacagatcccttgacaccttttaagtcatcatcataataagcctccaatccgagaaggccctggttatcaataccggcaaaaccgagaacatgggacaaaaagcttccgtacggataatgacggatgctgtcttcagccacataaaccccttttaagtcgagcgctttgatttctttcgcttttttattggaaattttccgcccctcgggtgagattttttctatggaggttttcttagtaatatgtttgtagaccttctcttccgacatatttaaaactgacgcgagaagcttgcccgtttttatgggattttgaatctggcgcggtacgacaaagacggtcggcgcgcttttattcgtagccagcttcacgccgtttcggtcaaggatctctccccgctcaggctcaaacggcaaatttcggctccaggaatccttagccagtgaagtcagcttttctcccatcacaaattggacatagcctaacctgctgtcaatgatcaaaaaaatgattacgccaaaaagcaaaaccagtaataaacgttttcgaaccgttacatttgaaacgcgcaagggaccgtccactccttatttaggcttgtttcaatttatgcctcagcttggacacatagaacggcggcgcataaaaaagaagcccgcgggcatccgcggacttctctgtcccgttaatcaggatttttaaatttcaccttaatcacggtattttctttcaattctttgccttttttcacactttggcttgaagcgtaaccttcaccgctcacatcgatgtgaatgcctgatactttgctgaattgaagcacttcccgtctcgaccatccggacatatccggcatcgtcatctttccgtctgtttttaagaagattttctgattggtgatcacatcttctccggctgtcggatactgctcttttacggcaacatcgctgccgatgacaatcggtgtgagatgttcatttttcgcttccttctcagcgcccgtgactgtcttatctgtcaggtcaggcatcttttggcttttcgtttcttcctgaccggaatctgttttttccgtcggttcgatattcatgtagtggaggctgtttttcatcgtcgggttaaagatttccgcaacaggatcagagctgctttgccccgcttttaactgcggctgctgcacggctacatagatgacgagcttaggatcatttttcggcgccatgcccatgaatgaaaacacatagttgctcgttccccttaaatatccgcccgtcccggcgatttgtgcggttcccgttttacccgcgacgtcaaaaccttcaattttataaggtttccccgttccgatgtctgatgtcacgacttctccgagcaggttccggacttttttcgccgtatcggctgaaatcggcgtgcctacttgctctggttttgtctgcttgacgacttttttcgtatcggggtcgacaatatgatcaatgacgtaaggtttcatcattttgccgttattagcaatcgccgtgacggcctgaagctgctggatcggtgttatcgccgatgcttggccgtaagccgtagacgctttgtcaaaatcatatttgtagttaattttacttgatacttcaccgggcagatcaatccctgttttttgatagagcccgaatttgtgcaggtactcattaaaccggtcaaaccccagtttttcattggccagtttggcgaaagcaacattcgatgacctcatgaggccgtcatggaagcttgtcataccccatccggcgccatcgttccaatctttaacaggtccgcctcccactttatatgttcctgatttatatttctcgtttgcggaaaacacattttcctgaatcgccgcggcaagcgtaaagatcttcatcgtcgatcccggttcatatgcgtacgacactaagtcgttgtaataattggtgacgtttctgatattcgggtcaaaactcggacgctgccccatcgcaagcactttgcctgttttcggttctacgacagccgccataattttttttggtttatatttttccgccactttcgtcatgctgtcttctaaaaaggtttgaattttctgatcaatggttaaatatacattgtcaccgtttttaggtgcggtgattttttctttgctgttcggaagtttccagccggatttatcactttcgtaagtgacggacccgtcacgttccgtcagatagttatttagtattttttcaagtcctaaagagccttgtatctcgtttgttttttcattcacatcggcatagccgagaacatttgacaaaaatatgccgttcggatagtagcgcttcgtatctcttaggaaagaaatacccggaagattcattttttcgatcttttgttttttcgcataagagatatcgcggccggctgaaccgaattccacctgcttcgcgccattcctgtttaagatgtccagaatctcgcttttatcaagattgataacggtcgccagtttttccgccgttttctctttgtctttgacatgctgaggatgcttcggatcactcgtcatttttttatcaagcacggcaatgagcttatatgtcgccgtgtcctctgcaagcactttgccgttccggtcaagaatagagccgcggctcgcttctatcgtccgctttttttcgtgctgctcggtcgcttttgttgcaagctctactccgtttgctttaccggttaattgaatgtacgccattctcccgagaatgacaaagaaaaagagagcgaaacaaatactgagtatcgctgctcctctgttcataaacttattttttttcggcatgggttatcattcctgtatgtttttcacttttttatctttcagattcaaaccgtgctttttagcgatatccatcaggcgctgcggctggcttaagtcagcagccgtcttttcgagatcaccgatctgcttattcttctcagatactttctcctccagtttttgcacctcaatattggattgatacgccgcgtatgcctttgatacgataaacattgatgtggagagaacggcaatggcaaacaggacgagcagcaccttttccccgagtgtaatggaagccctctttttgacaatcacctttttttcgggacttatcactggccgttgttgtttttcctgctggtaagctaagttgctcataggctgatgacctcctttaatgttgtcatttgctgcccgttattttcgtttctccgcaatgcggagcttcgctgaccgggcgcggttattttcttcaagctcctcttttgatgccgtaatgggctttctcgtaatcagttttaattccggttcaaattcttccggtatcacgggaagacccggaggcagttcgggaagtgatgatttttccttgaatgtcgtcttgcacattctgtcttccagcgagtgaaaagtgatcacagacacccttccgcccggcttcagcacctctatcgcttgcaagagggcctcttcaaatacctgaagctcgtcgtttacggcaattcgaatggcttggaatacgcgtttggccggatgacctccgcttcttctcgccggagccggtatcgcgtcctttattagatcgaccagttggccggttgtttgaataggcgatttttctcttgcctcttcaattttccgggcgatctgcttgctgaatttttcttctccgtatttaaagaaaatcctcacaaggtcctcataccgccattcatttacgacttctttcgccgtaagggcggccgactggtccatcctcatgtccagcggtgcgtcatgatgataactgaatccccgttccggtgtatcaagctgcggagaggatactcctaaatcaaataaaattccgtcgacactcgtaatgccgtgttcatgtaaacactcttttaaataacgaaagttgctttttaccagaatgagctgtcctttgtattcggacaatgttttctgtgcgttttcaagcgccgtgtcatcttggtcaaaggcgatcaggcgtcctttttccgataattgctgcaataaatatgtactgtgcccggcgccgccaagggtgcagtccacataggttccgtccggtttaatatttaaaccgtcgacggtttcacgaagaagtactgtcttatgctgaaacatttgtgtcggtcccacctttatcaggaatgaattgaattgtcagttgttgttgtgatgcacgaagatccattatatatcaaatccaatcatgttttcagcaatttcagcgaatgaatcttcttgctcttctgtgtattgttcccatattaccttactccacaattcaattcgattggaaaccccgatgacaacacattctttttccagttttgcgtaattcagaagagatgacgcaatattaacccttccctgcttgtccagttcgcattcggtcgcaccggaaaaaaagaatcgggtaaatgcgcgggcgtcttttttggtgagcggcagagccttcagcttttcttcaatcagcttccattcattcatcggatagccgaaaaggcattggtcaagtcctcttgtcagcacaaactgctcaccgaggccttctctgaattttgcgggtacgatcatgcggccctttgcatcaattgtatgctggtattcacccataaacatgataaggacccccactttctcccctaaactcaccactatccgccacttctctccacaacctcattttacactgtttacacataaaaaaaaaccctgaactattcagggttctttaaaactttatttcaaagtttgacaatctgatgttggttttgaaaagaaaatggcagatgtttgaaggttgtgaagaattttggaccataacggttcaaataatacattacattccaaatccgttcctgcggagcgccgagcggtctgatgctgttttggattctttcatagtcacgcagcacaaaaccttctttttcttcaattcttttcgttaccgtccgttctaaaaacaagagctgatcctgaatgaaggcggcattcttctgtaagagcggctcaaggcttgaatcgaccttcagcgcttcgttccttgcgcttttatggacagcttcaatctgcgacttcgcctgttccattacagaagaaaactcttccggaatctgctcttcaaaataagcgtctttcaggtgtccggtgccgtgttcgatcgcttcctgaagcggaatattccgttctgaaagcttcttttcaatatggcgctcaagaatcgtaatgttcagtctcggcactaccggcgtcatgcggaagcccattaatgagaaagcctgcttcagctcaccccaataattgatctcccccggtcccgcgataaacgccagagtcgggatgagaaactcctgcataagcggccttgtcacaacgttattgctgaaacattcttgtttttcttccatatgggtatgaagctcgtcgttcgtccacttcaggtcaagctccttaatgacaaaaacgccgttttctttttcaattaagaaacgctctccctcgtgttcgtaaaacagattagcctgatctttgtccgattcaataatcgggtgataaccggcttgccgcataagacgctgctggtctgacacggctttggcaagctcgtgattgtgttttaaaatctgctgaaacatacccgtttccagctttttaatccccggatctcccgaattcatcagaataaggccttcttcttgaaacaagtcggcgatcaacagctcaaaaaagtccgtgaatgtctctgatgagcgtaaacatcgcttcacgttttgaaggagtgtgtttgtgtgatccgtttcctcaaaagcagcgaacacttcatcaatccaagccgcgcatttttcctgatcaagctcggttttagccgccgatgtttttttccagtacgactgcggcagtttccgcttcaccggacctttattctctgttgacgtatgcacataattaatttcttccagatcgtgatcttcacccgccacccagaaaatcggagcgacaggaatctgcagcgcctcttcctgctgtctggcaagtacgataatggagataattttatgtatggtgtaaagaggccccgttaaaagaccggcctgctggccgcctacaatcgctgcgctttttggatctctcagtttttcgatggaggcctgcatggcggcggagtgaaatttttcgtgataggaggataaataatccgctaattcctctctggcaaacggccgcgaagagaggtcatgaagccgcttttgccatacgtcctctgaatgaatatcataatcaaaaaatgaagacatgttttctccatctatatagtgctgcacaaacttattttgacttttgatggaaagttcagttagctgcatctgtctggaacttcctttctccaataaatagttaggtttccgaaatgagtatagcatgttaccggaaaacctcaaaagactttgtttcaatttctttctaaagcttttatgctgcggtgtaaaaacgtgagatgaacggccggcaatccgcggctttccgcttcttttacaaggtagccgataatcgcatcggcctctgtccgcctgcctgccatgatatcgacgagcatggaagaatgatttttttccgtcagtctgcaaacttcgcaaaccttgttccacgctttttctctatcggcgaggccaagtattgtctccgcttcttcaaacacatttctcatatattttttgtaagcgtcatttcttaacagctctccgtttttcacgcgcagcaatgcagttaacgggttgatgcatacattgatgatcagttttcccgttaacagccgataccagtcgtcttcatcatatacgggaaaatcccggtgcatgccggaaaagatgcttttgagcgtttccggccgggatgcgctgaatacactccatcttacggctcccgctcccgtatgttcaacggcatgatccgatatcttttttgctccgtgctcaacagtgccggcataaagcgaatgatccgtatgccaatctctaatgtcgtgtatgtgtcccatgccgttttgcaaaaacagcacattcgtcccttttaccgtctcaagatcccgcagcacagcactgagctggtgctgtttaacggctgcgattaagaggtcgaatccggaagtgatgcctgtttgcgctctgcatgccgccgtacattctattccgtctttcaaaagccgtataccgcctgagttaatcgcatcagcctgctccgtccgccgcgtaatgactgttacctgatggcgggacgataagtagtaagcacataaaaggcctaccgctccgccgccgataattccgattttcacactgtcacaccctatatctgcatttttccatattatcatagcagaagccgccgcaaattacttcaatttcgttttgagcaaaaagacaggcaagcatattatagttggaattttcaattaaagcgtttacaataatggtagaacacaacaaagggggagtttgtgttgaaaatagagcgcctgctcatcaactttaagacactcgaagaatttaaaaggtttaaggaatacgggatgcaggagctgtcgatgcttgaagatcttcaggataatatcattgaaaatgacagcacctcgcctttttacgggatttacttcggggataaactagtggcgagaatgagtttatatcaggtaaacggaggcgcgaatccgtattttgatcagcgtcaggactttttggaactttggaagcttgaggttcttccgggctatcaaaacaacggatacggaaaagcgcttgttgattttgcaaaatccttcagaatgccgatcaggacaaattcacgcatgaaatcagcagaattctgggataagatgaatttcgagcccgttaaatatgatatggcgcgtgataaaggagaaaatccttacatctggcatcccgatatggacggtgaaatgacatccggagaaacggcataataaaaaaccggccgggccgccgccctcaggccggttcattttacaggctctgcgccgatttcctgtcgtcttcttttgaattgaccatccttctcgctctgtccataatgtcaattaacgctttataatcttcttccgtcatctccagcttgtttctcaagctttcattttcctcacgcagatcctcgacttctttttgcagcgcggtcagctgttctgtgagtttttctttttcatgacgaacatccgctgcggccggcgactctttaaattgctgaagaaacaaaatgacatcatcaatggacagctctttttctccttccgccctgcggatcggaggctgtttgacggttcccggcagattggcggaatgcaccccgatctgctttcttaattccttccgctgttttttcgccagttctatccctgactgatattgttttctgacataagaattccatctgaacccgcaggcggcagccgttctcgtcagcgctctgccgacttcttcaaaagcggaaagctgggtcccgccttcccgaatatgcctgagcaccacttcggccagcagcaaatcttcatcttgcgtccacgcgtcttgtctcgttatcgtcaatcgtatctccctccatatttgctcatttacctcatacatatgccgctgatagattagatagactactggcgctcacaattttttcggcggaagcaggccggaggggcaaaaaaaaaagaaaagcgcaggaaccgagattcccgcgcttttcttcatacattaattgcttttaacatttatgtctttgccgttgtatgatccgcatgctttacatacacggtgagacaatttcatctctccgcatgacgggcattctgtcataccaggtacatttagtttgaaatgtgtacggcgcaatctttttttcattttagaagttcttctaaaaggtacagccattattcccacctccttaaagagttaagattcatcatcttgtgttaagagctttttcagatccgcaagtctggggtcgatttgatttttcttgtcttcctcagaaatcacttgccaatccttccccacttggggagcggctccttctttttgttcagtttcacaaaagacttgcataggaatttctaaaagaatctcttcttttacgatcggagttaagtcgacgatatcgtcttcagcaatatgaacgtcctcatcttctatatcatccgacttatgaaatctaaacagttcttttgtcgcgattgtaaatggatacggcacatcaactaaagttcttgagcacggcaaaaccatttcgcctgaaatcgtaaagtcaaacgaaacttgcttggattcaatctccgcgcggcccttcacccggacgggagaaatgcggcggatgtcagaattcaattttgtcagctcatttaactcaactgtttcatcaaattcaaagctctttttcgccatttgatgaagctgataaatcgtccatttcatttgtatcacctcaggaaagcaacaaacatgattatagcttttcagaatgtttttgtcaatattttttctttacagcataatgccgccgtcatgcaatcgttgacagccggataggctatgcatacactaaacgaaacggactaaaatatgcacttcatttgcaaatgtaccacacgaagcaaaacatagcaagaaaggcgggacaaatatgaaagcagtcggcctggttgttgaatataatcccttccataacggacaccgctatcatgcggaacaagcaaaaatcaaaacggacagcagcgtcgcggcggcggtgatgagcggcccttttttgcagcgcggagaaccggccgccgtctcaaagtgggcccggacaaaaatggcgctggaaaacggcgtggatatcgtcattgagctcccttatatgtatgccgtacaaaaagcggaattattcgcgcgcggcagcgtttcgcttcttcatcatttaggatgcagcagcttgtttttcggcagcgaaaacgggcggatcgaaccctttattgaagcgtctgaagcgttcagccgaaaggaagatgactgcagcctgattctgaaagaggagctgaaaaagggtctcagctatccggccgccgcctcaaaagctttttcacacatattcaaagggcgggacatgctcgatttgtccaagccgaacaatattctcggttttcactacattagagcgatacacgccttcggttccgctatgaagccttatacgacagccagaatcgcttcccagtatcatgacgccgagcttcccggagataacagccggatagccagcgcaacaagcatccggaaagcgctgatagaaaaaggaacggcggccgcaaggagctttctcccggaagcgtctgcgcgtgagctggaggcatacagaaattcatacgggatatggcacagcaccgaagactatttttcatatgtaaaatacagcctcagcactctgtccgctgaagaattgagccgaatctatgaagtggaagaaggccttgagcacagaattctgcgcaccatcagacaagcccgatcctatcgcgaaatgatggaacgattgaaaacaaaacgatacacgtggacgaggctgcagcggatgaacacgcacattctgacacggacgaaaaaggaggacatgcatcggctcttacagccttcaagcgctccttatatccgtcttctcggaatgacgaaaaaaggacaggcgtacctgtcggcaaagaaaaaagagcttaccgcacctctcgtcagcaagctctcttctttctctcatcccgctctggatctggacatactggcgggacgggtttacagcctgccgataaaagaacctgaacgcacattgtttgagaaacaggaattttcacaagcgccgatccgctatgatgaagacgaacagcgttttttgaatgcgtaaaaaaagcacctgcctgtatcaggtgctttttactttcagctgatccaaatagtcaagtgcgtcctgcatggtgtcgacagggacgatcttcatatcggacttgattgctttcgccgtttttaccgcatttttgtaatcagaattttcagctccgttttgattcggcgcaaagaaaatatcttttcccgctttgtctgcggcgacgactttctgatcgattccgccgatcggtccgaccttgccgtccacgtcgattgtccccgttccggctatattatagccttttgtttcgtcaggttttgtcagctggttgtaaatttctaaagacatcatgagacccgcagaaggcccgccgatattttcaatgctgaaatggagatccggctttactttcacgttccgatccgtatataacgcgacgccgattcccgctcttttcgggtcgtccgggaatgatttcagcacaatgtcaacggtcttttctttcgtgtcccgttcaatgtggaacgttactttttcccccgcttttttgctgctgatataatcaatcagcttttcagcggattcgtatgttttcccgtccgcgctgatgattttatctccgacctctatttttccttttgccggcatgtcagagacgactgagctggcgaaaatcccgttaaatgagtatttcacctgtttcccggctttttgataagcggcaatgaccgcgttttcttgggagcttttcatcatttgcagctggcgcttcatataatccgagtccgattcgccctcttcttttatgctttcatcagggacgatttcatcgtaaggatgcactttcgcccaaagatatgtatacggattggcggggcctactttgacagtcatcaaggaaaggcttcctttttcaggatagcctccgtccaccttaatcagcggtctcagctctgatgcttctcccggctgtgtaatataatacggaagcttaataaatgtaacagcaattaataagatcaggatgataaacacccagcgaaaatgttttgctttcatatgagttagccctcccagttctctatttcttgtttaatccggccgatcatccggtctgcggcttcttcgcccgctgtgatcatatgatcaatgttggcaaaagaacttgagctgaatgattcaagagaagggcggatcatgacgtctgcggcaatggtctggtgacggaccaattcattttgcagtatatccatactttgcatgattacatcaaaaatatgtgccgctttttccgtttttttcacccgggatacgtcagaggcgatgacgatatcagcacccatgtcttttacggcggacaccggtattctgtcgaccaccgcgccgtcgactaacatacgtccgttcattttttgcgggacgaaaacgcccggtatgctgatgctcgcgcggacggcttcggatactgaacctttcgtaaaaacgagtttttcgccggtctgaaggtcgcaggccacgatgccgagcgggatccgcagttcttctatcggcttgccgtacgtataggcatgaacgagctgcctgatgcggtctccttttaaaaatccgagcctcggcatcgtataatccgcgtacagccgccgcttaaatgctttggcgacttttttcatcgtagccacgtcatgcccggccgcataaaagctcccgactaatgctcccatgctgctgccggcaatcatatcaattggaatctgatgcttatgtaaactggataacactccgagatgagcgatgcctcttgcccctcccgaacctaacgctaacccgattgtaggtttggccaacgcgacgaaccccctaatagacatcctatacatgaattctatggtctaaattgaacccctatgctcgtatattagtacaggatgacaaataggtacttgcccggccgcctttaaggtctgttctatattttatcatgatataaatgtcagtgtgcaattttagcatcggggaggtaagaatgaatttgtctaagtttcatacatttttgatttcattgtttttcatttttttgacggcgacggttatttcacaccctcaggcctcattcgaagcctccaaaaccggtctttccatgtggtgggaggtcgtttttccttcattgcttccgttttttattctatctgagcttttaatcggattcggcattgtcaaatttgtcggccttttactcgaaccctttatgcgtcccattttcagagtgccgggggtcggcggatttgtactggctatgggcatggcttcaggcaatccggccggcgcgaagctgactgcacggctgcgccaggataaacaaatctccagagtagaggctgaacgcctcgtctcttttaccaattcatccaatccgttatttatattcgctgccgtggcggtcggcttttttcataacgcgtctctcggcattctgctggcatcggctcactatctcggaaacatcgccgtcggcctgacgatgcgttcatacggacggaaagaagaggcagcatataccggtaaaaagacgatcgctctcccttctctgaaggaagcatttctggccctccacaaggcgcggctttcggaaaagcggccgctcggaaaaattttgggcgacgccgtcacttcttctgtacataccttgctgatggtgggcggttttattatattgttttcggttttcagccggttattatcaatcgtacaagtcatggatgtgctttctgtatttacaaacgcgctgctttccctttttcatcttccggcaaatctggacatccctcttatcagcggaatgtttgaaattacacttgggagcaagctggtcagtgaagctgatgccgccttgctgccgaaagccatgattgtgagttttattctcggtttcagcggcctttccgtacaggcccaggtagccggcattttatcggaaacagatatccgctttaaaccgtttttcgcggcgcgtatccttcagggcatttatgctgcactttttattctcttactgtggaagccgctttaccttgcattggacgaaccttatcagtccgtattcctccctttccgcgatcaggacgcgggatctgctgccgtcagcggatggaatacacttgttgaaaccgggcccgccatcacgctgacagctctcgccgtatacgcattgatttattgttacaggctgtcagcacggacaaaaaaaggatgagacgccgatcagcgcttctcatcctttaaatttctgcttcagcgcctgttcaacttcctgaggaacaaactctgaaacaggcccgttatattttgcgacttcttttacgatgcttgaacttaaaaaagagtactgattgttcgtcatcataaaaaaagtttctattgattcgtcaagcacgcggttgacggaagtcccctgcatctcatattcgaagtcagaaacagctctgagccccctgataatcgccttcgcccgcttttttttcgcatagtcgattaacagtccctgtgacgtctcgaccgtaatattcggaatgtcttttgtcacttctcttaacagctcacagcgttcctcgactgtaaacagcggctgcttagaagaattattgagcacgcatacgtacacatgctcaaacacgtttgccccccgtctgataatgtccaggtgtccgtaggtgacgggatcaaaacttccgggacatacagctatacttgccacatcattaccccctatttcggtatatcgtcactcctgtaagcccgtaaatttcccttcttgttacagaaagcgcgccgacggcttcaggaagcacaacggctttatcatgctcggctacgacaaaaccgtcttcattcagcatgttctgctcatcaatcatttcgataagcgctttcagcttttgttccttatacggaggatctaagaaaattccgtcaaaacctttttcccgtttcaccgcggcatagagggcccgctctgcatcattgcggtatacttccgctgaagacagcagatcgagcgctttgatatttgcttttaccgtttggatggctttgaaatcacggtccacaaagatacagcggtcaaatccgcgcgacagcgcttcaatcccgaggccgccgctccccgcaaacaaatccagccctgttcctccgtcaaaatacgggccgatcatattaaaaatagactcttttactttatccgtcgtcggccttgttgatgtgcccggcaccgcctttaaggctcgtccttttcttgaaccggaaattactctcattattcacaccactttttctgaaaactttgatgtttctcatcggctgagccgttatgtataaaaacaatccctatcttatcataaagcattctttcaaacaatgaacgtgaaaaacgtgtatacatattcacattcctgtcaagactacgtgtaacagcatcaatgaatgatgttgttgccaaccgcggagaagacttacgtttccccataagttcttcctccggtttctcctctcccttttccttctccttaacttgttaaggaatagaaggaccccgcaggtatctgcggggatttttttatataccgactttataatcgtactctttcgctttatcaagctttgattcaaattccagctttaaaaaaggtttataagaaggctctaccttcttcacataagaataagaagaaatcttttccattgttttttcgatcaggtccatatcgcaatacagcacaacgtatttcagccgcttggaaacataatgaacgttgccgaattttctcagcattttgctgtgttttaaagaatgcagatatacgattatgccttggcgcttattttccatcatgatcacccgcctgactttctgttcattttatgtaaaagacgagacggccgtctcgtcaggaaactttgcatccgcagccgccgccggaaccgcagccgccgccgcaggatgacaggccgtcaaaataaggattccccgtcggcacttttacatgctccgagacggccgttccgagttcaatgctgatctcgtcaagcagcgactgaagctcagtctccgcttttttaaattcggccaccttatcgtttaaatcgagctcccgcttcatttctctcattttgcgggaaatctctctataatcaggatggtatttgccaaagcgctgcacatcctcatactgctctttaacgctcataaaagaacgaatgatccgccctgcctcttcatcttcacggagacgcttgtaacaatcgcggtaattttcagccgtctcagactgcagaatcatgccggcaagctgttccgcttcactttgaagcttgacggactcaattgttgcatacataaatacgcacctccagttgctagtttaccatgaaaccacccaattggaaaatgcggcgtttaaacgctttttaatcctgcgaacgcatggcgtgtaccatctgcatcatcatctgcgccatttgaatcccgtttgagaattgacttacccgatgcggtatcgtcttttcataaaaattcatcatgtcaagctgaaaggaattgagatcgtccggttttctcgcaagtctgcggtaccagacgggacgctgccgtataaaccgtttccgttcctcatctgcggatatgaattcctgaacctcttttcgcatacacgatccccttctttaatcctttctgaatgaaaaaggatgttgtccggagccttgccggggctgcttcgtgctgctccccgaaaattggcttaaaaggctttgcaatgatgaaatggactggctcattttattgatctgctcattcatttggttgatatccatctttttgacggcagtgaccatttttgaaacgaaatcgttcttttcagctggttcctgtttggtttccgcgtcggaagaaggctgaacggcctcgtctttaaaaggatcccacatcgaatcatcctcgcccaggagcacccagttttcatagacttcctgccagcttctttgttccttgcgaacattttggatcagtttgggatgcttttttacgaattgtttaaaatcatcgattgattgccgtgattgctgattcgccacaattctcaccccctccgaaaagttttgcctgctataatgtatcggttcatgcgccttaatgttcgcctaaattgcgaaaaaaagcaggtatatttttttcagcaggagcgccgctcgcgaaaaaacataaaaaaaccgcgggggacgcgcccctctgcggttttttactgccaaggcttaatgaagttttgcgtataatacttccggtccacgccgacaccgaggtgcgtataatccgggcttaacagcgccttcctgtggccttcgctgttcagccagccctccacggctgcaggaccgtccacatagttgtaggcaatattttcaccggcctcccggtatttcacatcgcctttttccaagcggtccttcagagtcccgtatttctttgagacgtgagagaaatacttgttatccttcatgtccttgctgtggccgaatgccactttcgcggcgccttcgtcccatttcagccttgccagtccgtgtttcacgcggatgacatttgtaatgtcgagaatctgctgttcactcgctcgttcaatgtcgttccattttttatcagaaactggctcgggttctgtcagctttcctctgtacatgacctcatacggcctttgtttcaccagcgtttccgcatcaaaagccctgatgcttgacagattcccgtcaaatttgtccatgtacagctgaacatacattccgcctatcttgacggtgggacgggtattgatatcttcttcggaaaactcaaaccgatacgtgtttcccttgtcagtcacattgacaaaaggagaaacctgcgtcgttttaaaaacttcgcccgtcgattcgccgatcttaaacggttttgcgttgatgccgcttcccgaagcgtataaagtcacggctttatcattcaaaataccgacttgtacgtattggtctttcccctggttgtacacccaccactcgtaatcgtaggcagaaggatctttccgggacggttccccaagtttctttttcacatcggcggcagatttccccatgagagaaagcagtccggatgacggcattttcagccgttttccgctctcttcttcattggaaacctgaggctcctcctgattggtctttttctgaggagccgatccatattgtataaacagaacatacgctccgtaaataagcaaaaggataacgagagcccttgcaatatttttcaacctctcacccccatatcatcaaaccgttctgtttttgtgtactcttatacagtacagcctatttgcatcgtccgtgatttatgtttaatggataaacccctccggacctccgtcttcagaaatgtcagacagcgcccggcctgcttgctcatttgattgctcggccaacgaaagatcgccgagcgtaacaatgccgaccagttttttatcccgtgtgacgggaattcttctgagctgatgttcagccatcaaatggagcacctcctccacagaggcgtcttcttctgcactgataacccgctctgtcattgcgtcggttattttttgagagttcggcttttttgaagcaattccccgtaatacgagatctctgtctgtcacgatcccgacaagtgtggcgccgtcttcatccactatcggaatggcgccgacatccgcgtctttcatcttcaccgcagcttcatatacattatctaatactgtacaatattgcaagtctgacgtcatgagcttattgatctttgtcattgcggaattcctccttttttctgctactattgtcgtcaaatttttgtttttgcatactttcaccgtatgaatcattgaaagtgtaacgctttcatactatgattgtcaggaaagggcatttttaaaaggagggggaaggtttgaagtttgaaaacagcggtcttgaaggggtaacagcggagctcagccgcttgaacgatctgatggaaggcaaagggctcattctggctggacaatgggattatgaaagagtgacttacgacaaaaagttttcagtacctgaggggacattttatctgcggattcaaggaacggcaaaagagggcgatgtcggcggcagacgggccgtgattcagctgaaggcccctcttttaggaaagcattattatccgcacggcgtagaatacggcagcgctgaagaatttccggaacatgtcgtcgctgaaagcaaagctttactgcttgaattggaagagtcattaaaaacagtgcaaatgtaataaaaaagtacagcatattctgctgtactttttttatgagacggtatgctcgatatacggcggctctgacagcgtatctttttcccgttccgttctgacccactgaaaaaagatgacagccaaatatattccgtagaccgcctcttgaatgattttcatcagcactgctccaagctgctgatcttccagaggaggtagcgtgttaaacatctccggcccggataaagggatctcctccagcaaatctaaaggaacgcaaagcttcattgcttcggcccaagccgccggatctgtatacgtggcatacatgggcgccccgctgaacataatgagcgcgcaggccggcgttaacaaaatcccgtccgccataatataccccagcttcattaaaccgctgagacggggcagaccgtccaccttatgcacaagcggccaccacataaaaaacgccgttacaaagatgagtccgttcatcagcgtgtgatacagcgaatccgttttgacgaaatcaaatataaacgggatgtgatacagcgaaaaaataccgttaaacagcactaaagcgataagcggcattgaaaaaaacgaaaacagcggctttacgacaggacggaagatcagttttttccatgcccagccgggaattccggagatcaacagcggcggtacgactaaaaacagaaccgccatctgcgccatatgggcgctgaacatcacatggcccaataaatcaaccggacttcccgcagccgcgtaaaaaaatagcgcggaaagcacaaacagcaccttctccttaacggccacacgtcctttatgcctgctgcaccagtaaaagtaaacacctgttatcacggcagttatacaaaacagatacgggctccacattgcgcgaaacccgaacatttccaaattaatcaaatctctcactccccgccgccccgattaccaccaaataattgtgacaaatgcaagcacggtgataaacgcgacaaatattcccgaatacagaaataatgacggcgcttcatgccccttctggctcatatgcataaagtaaaacagctgaaagatgacctgaatgaccgcaagcaggatcagaaacggcatcgtaaaccatccggcaatgccgtctgcagccaccgtcaaaaacgcgacaagcgtaaggccgatcatcaagccgaaggagatgacctgatatttcatctcctcggcatttttccttctccgatattcaagatccgtactgacagtctctctgtttttgttatcgtccatcgttatcccaccatccccatcaaatatacaacggtaaagataaagacccacacgacatcgataaaatgccaatataagctggccacataatatttcggcgcattataaaggctgagccctcttttcgcattccggatcatgagcgcgctgatccacaacagcccgaacgccacgtgtgctccgtgtgtgccgacgagcgtgtaaaacgctgagccgagcgcagagcttgtaatggtaaatccgaactcgtgagtgtaatgcataaattcatagatttcaacccctaaaaatcccgctcccaataatacggtaaccagaagccacacctgcatttttttaaaggagaaatttttcatatgatacatcgcatacacactcgttaagctgctcgtcaaaagaagcatcgtcgcgataaacacgatcggcagctcaaacatctcagccgttgacggccctccggctttagattcccgtaaagcaaggaatgtcgcaaatagcgaggcgaacagaaccgtttcgccgccgagaaacagccaaaatcccaaaaacttatttttcccctccagcgttgctttttcaggagaagccggaaaggtttcagccgtcattttttcctgcagctgcattacgccttcacccctttatcatcattcggcagatcttctttgtgaatatgatagccgtaatcatcgaccacagagcgaagcagcatggtaaagaatgtgatgccgagccctatgaagataaccggaagcccccatgaataatcggagtggtataaaaacccgaacgctgcgacaaacagcccgaaagatatgataaacggcatgatggagccgttcggcatatgaatgtcctctacaggctctgcaggcgccatcccttcatttccggcctgcttttcaatccacagcgggtcaagtccccggacaaacggaagctgtttaaaattatattccggcggcggcgaagagaccgcccattcaagcgtacgaccgtccagccacgggtcgttcccgacgtatttcccctttattgaggtataaataatattgacgacgagtaaagcggccgcgcctgccatgaaaaacgcgccgattgaactgatcaggttgccggtatcaagcccctggccgggcagatatgtgtaaacgcggcgcggcattcccatcaagccgagaaaatgctgaatgaagaaggtaagatgaaacccgataaaaaataagacgaacgaaattttccccatcgtttcatgaagcaccttcccgaacattttcggccaccagaaatgcacgcccgccaggatgccgaacacaacgccgccgataatgacgtagtggaaatgcgctacgacaaaatacgtatcgtggaactgataatctgccgctgcggccgccagcatgacacccgtgactcctccgagtacgaaagaaggaataaaggcgacggcatacagcataggcgtcgtgaatttgacgtttcctccccagatggtcaaaagccagttgaaaattttaatgccggtaggcaccgcgatcgccatcgtcgcaaccgcaaatatcgcattagcgatcggtccgagtcccgttgtaaacatgtggtgaacccataccatgaacccgagaaagccgatcagcacgatcgcaaagaccatagacgaataaccgaacagacgtttcctcgcaaatacgggaatgatttctgaaaaaatcccaaaggcgggaagaattaaaatgtatacttccggatgcccgaaaatccaaaacagatgctcccagattatcgtattgccgcccaattcaggattaaagaaattcgttccgaacaaacgatccagcatcatcagcgccaaaccgacggtgagcggaggaaatgcgaataaaatgagtgccgacgccacaaatgtcgtccacgtaaacagcggcagtctcatatacgttaaacccggcgccctcatattaataatcgtggcgagaaaattgatccccgcaatgagcgtacctaagcctgatatttgcaggccgagcacgaaaaagtctatgccgtgccctttcgaattcagcgcaagcgacgcgtacgacgtccagcctgcatcaggagcgccccctaaaaaccagctcagattcaaaaagatgcctccgaagaaaaacagccaaaatccgagcgcattcaaaaatgggaatgatacgtcacgcgccccgatctgcagcggcacaaccgcgttcatcagcccgaataacagcggcattgccgccaggaagatcattgtcgtgccgtgcatcgtcataatttcattaaactgctgagcacccataaaatcgttccccggcctcaagagctgaatcctgataagcatggcctcaagtccgccgacgacgaagaaaaatcccccggcgatcatatataaaatcgcgattttcttatggtcaaccgtcgtcaaataatcccaaagcaaagagctttttctttgctgtcctgtaagcgtattcatcatttgcgacctcccccctgatatctccctgtcctcacttgttctccgctttcagcccttttaaatattcatacagcgcatccgtttcagcgtccgagagcttcggataagtgcctgtcattttattgcccggtttaatgctgtccggatttttcagccaggcttttatattctctttattcgcatccttaatgccggccactttgacccgttcaccgaaggtagcgaggttcggagccgttcttgccgcttcagcccgtttatcattgggctcaaccgcatgacagctcaggcagtttttttccttaaacagctcttctccttgtgctgctaaatcggaatctgttgtatgcttataatttttcatcgctttcgtccattgtttaaattcttttgacggcagcggtttcactttgaaatccatcagcgcatgtgaaggtccgcacagctctgcgcatttcccgaagaaatattctcccgcttctttgctgcgtttagaatcgaaggtcagaaagaaagtgttgtcattatccgtattcgtatcgatttttcccccggctgacggaatccagaaagagtgtttcacatctgaggacttcagcttgaaatagacgcgttcatctgtgggaacgatcagctcctgacttgtcacaaacccgtaatcgggatactcgaattcccaccagtataaattcgcccttacattaatcacgagcgcatcctctgctttacggtttttcttatccatcggcgacgtatccgccagtgccaatgtatcgatgacaaccggaatgacaagaataatcagaagcaggatcggaataacggtccaggtgatttctaaaaaacggttcccctccacctgtttcggtatcgtgtcttcccctatacgcgaccgtctgaatctcacaatgacgtaaaagaaaataactgctacgaccgcaacgacgacaaccatgataagtgtgctgagcaccgtcagatcatattgtttatcagccacttcgccggcaggcttgagtgtggacagaaacggttttccacagccgctcaataaaagcggcactaaggctaataatgataaaagacgccaacgctttaacatttcacccaaccccttttttgaatcagtacgagatgcacaagcagtaaatctgcttccagccgaaatacttcatttcctcatttcttaaaatatgagattttttacttaaaattccatctatgtataaaagcaaagccgcctgattaaacaaaaggtcaaggcggcgtttactagttgtcattgtttgttttggcgatcaaacaagctcattattcaattaaaacagcgtgaagaccaccatcgctacaaaataaatggtcatgtagttaagcgaatagacaaacataagggttgcccacttcatgatgtttttcatgcggaatcccatcagtccgagaacaagccatccgacattcagcaaagtgccgagaatgacgatcggaagaccgagactgccgaggaaaaacggaagcggcagcaggcatgcgacccagacgataatctgtcttttcgtcacttcaaagccgtgcactaccggaagcatcggaatattcgctgctctgtaatcttccgtctttttaatcgcaagcgctaaaaagtgcggaatctgccagatgaataaaatcatgaataaaacccacgcgacaacaccgatgtgcccttcaaccgctgtccagccgattaacggcggcacggcgcctgatacacttccgacaaccgtattaatcgtataacggcgtttcgtccacattgtataaagaacaacgtacgtaaacacgccgataaaaccgatgactgctgccatcacggtggtcatcaaaagcatgataagtcctaaagcaatgagtaaaattcctgaccacagcgcttgattcggctgaatctttccggttaccgtcggtcttactttcgtgcgttccattaaatgatcaatatcacggtcgtaatagttgttaaccgcacaagaaccggcgatgatcaaagaagatcctattaatgtaaaaagcacggtgtttaaattgcctaaaaaactcagaccggatatatgtaacgcaagccacatgccggtaaaagtcgtaattaaattcgaattgacgattcctattttgataagcgaaaggaaatccttccatgccgtcgtctcttcaatctgtccgtctatagctgtatcgtttaaaattctggaattagccataacgtaaacctcccttacaaacctaaagcaggttttttaagacctgcaactctatcatacaagataatgacctgtaaaaaaacatcctcttaaatattaaacgagaaacaggaatttatttgtgaactttttatgaattttaccaaatccgccggcttcataataaagcggttactttatttctatcagacccatctggaataatcaaccccattatctaagaagtcctgattctattatatttttgtgaacaaacagaattgagaattgccacaaaacacatattcgcttacacttggtacgtatatcattttgtccagtttgttaagaaggtgaatgtaaaatgaataaagctttgaaagcgctcggcgtgctgacgacgttcgttatgctcgtcgtgctgatcggcggcgctcttgtcacaaaaacaggatcgggtctcggatgcggaaggcagtggccgctttgccacggccggtttttcccggagcttaacgccgcttctatcattgaatggagccacagactcgcaagcggtgtctcaatcgttctcgtgctgagtctcgctttttgggcatggagaaaagtcacgcctgttttccgtgaaacaacctttctcgccattatgtccattatctttttatttttacaggcgcttctcggcgcattagcggttgttttcggatcaaatgcgctcgttatggcgcttcatttcggtatatcgctgatttctttcgcttctgttctgattttgacgctgctcatatttgaagctgataaatcagacaaaaagctcgtcaagccgctcagaatcggcaggaaaatgcagtttcatatgatcggcctttcgatttacacgtatatcgtcgtttatacgggggcttacgtccgccatacgaaatcaagccttgcctgtcctgacgttccgctttgcagcaggctgaaccacggacttccgtcccaatttcaggagtgggtgcagatgggccacagaacggcagcgctgcttctgttcgtatggattcttgtcgcttttgcgcatgcggtgcgctcctacaaagaccaaaaacagattcttgggggctggatagcggctcttgcctttgttgtattacaggcgctctccggaatcatggttgtttattcagaaatggccaccggctttgcacttgcccattcgctctttattgccggcctgttcggcgtcttatgctatttcttattattaatcgcccgcttccgctatgaatcaaaacagcggaacatctgaggcacacgaaaaggccgaagcatcagagcttcggccttttcacatataaaaaacctgatcgcacacggggcggatcaggttttttatgttcattttttacgctttttcaatttcgatcagtaaatcgcctgtctgaatcggttcaccgtttttcacatgaatctgctgtattgtcccggagaacggtgcctgtaccgtcgtctccattttcatcgcttcattaatcatcagatgatcgcctttatttacctttgccccggtttccgttaacaatttaatgaccgttcccggcatggatgccgcaatgtggcttgggtttgtccgatctgcttttaatttttcctgtacggacgatttaatgctttcatctttaatgaccacctcgcgcggctggccgttcaattcgaaataaacgacacgtgtcgcatctggctgcggttcaccgatagatacaagcttcacgatcagcgtttttccgcgctcgatttccacttcgatttcttcaccgagtgtcatgccgtagaagaaagtcggtgtgtccaatacggaaatatcaccgaagcgttcagccgttttaacatattcagtaaatactttcggataaagagcatacgcgattgcgtcctgatcactcaattccatctgatgcgtttctttccattcttctttaatgccttcaaaagataccggttcaagcagctcacccggtcttaccgtgatcggcgtctgtcctttcagaacgagcttttgcagtttttccggaaatccgccgtgcggctgaccgatctgccctttaaagagctcaacgactgaatccggaaaatcaagcgtttcgcctttatcataaacatcttgttctgttaaattgttttgcaccatgtaaagcgccatatctccgacgactttggaggaaggtgttactttcacgacgtcgccgaacatgcggttgacgacgctgtacatgtctttcacctcattccagcgatcgcccagaccgactccttttgcctgctgctgcagattgctgtactgcccgcccggcatttcatgattataaatctcagtatgcggagacttcatcccgctttcaaattcactgtaatactgacggacggattcccaatattgtgacagtctttccacctgccggacatccatttcaggacggcggctgtttccttcaagcgcatgataaaatccgcttgcgctcggctgtgaagtcagacccgccattgagctgacggcgacatccacgatgtccacacccgcttcaacagctttggcatagagaaagacgccattgccgctcgtatcatgcgtatgaagatgaacgggaatatcaatcgtttccttcagcgctgagacaagttcatatgcggcttgaggtttcaaaagaccggccatgtctttaatgccgagaatgtgcgcaccagacgcctcaagctctttcgccatagaaagataatattgcaaatcatatttcgtccgggtcttatcaagaatatctcccgtgtaacaaatcgcagcctccgccacttttccggtttcacggacggcatcgatggccagcgtcatcccttttacccagttcaggctgtcaaagatccggaatacgtctataccggactccgctgactgccggacaaatttttgaatgacattgtcgggatagtttgtataaccgacggcatttgatgaacgaaggagcatctggaacaatgtgttcggcacttccttacggagatcttcaaggcgtttccaagggtcttcttttaagaaacggtacgctacatcaaatgtcgcgcctccccacatttcaaggctgaacagttcaggccacagggcagccgtaggattcgcgatttttttcaaatcattggacctgatccgtgttgcgagcagggactgatgggcatccctgaacgttgtatcggtcaggagcacggatttttgctctttcacccagtctgcaagtccctcggcgcctctttcatcaaggatctgtttcgtaccgcttgccggcttttccccgatatctaacgtaacggtctgaggcttatcaaatgcaggtttttcttttttcccgattcccggaaaaccgttcaccgtgacattgccgatataggaaagcatttttgttccgcggtccttctgttttgggaaaacaaacagctcaggcgttgtgtcgataaacgatgtgtcgtattggcccgtcaggaatttttcatgctttgccacgttttcaagaaacggaatattggtcttaatgcccctgatcctgaattcctgcaggttgcggaccattttcgctgatgcctgttcaaacgtcagcgcccatgtcgacagcttgacgagcagtgaatcataataaggcgtgatgacggcgccctggaagctgtttcccgtatcaaggcggacgccgaaaccgccgcctgagcggtaagccataattttacccgtgtcaggcataaagtcattcagcggatcttcagtggtcacacgtgattgtatcgcatacccgtttgtaaaaatgtctttctgctctgggatattgacggcgcggctgtgcagtccgtggccctgcgcgacgagaatctgcgtctgaacgatatcaacccccgttatcatttccgtaatcgtatgctccacttgtacgcgcgggttcacttcaataaagtaaaattcaccgcccgctacgagaaattccacggtccccgcgttgatatagccgacatttttcgcaagcgccacagccgcttcacagatttcgtcccttaattcaggctgcaaagatacactcggcgccacttcaatgaccttttgatggcgtctctgaacggaacagtcccgctcatacagatggacgacattgccttctttatctccgatcacctgaacttcaatatgcttaggattttcgatcagtttttcaacatacacttcatcatttccgaatgcggctttcgcttctgattttgcccgctcaaacgattctttcaattcgctttcgcttcggacgattctcatgccgcggcctccgcctccgagcgatgctttaataataaacggaaatccgtggacttttgcgaattgttcgacatcttttaatgtttcagccggtccgtcactccccggaataacggggataccggctttttccgcctgctccctcgcctttaccttatctccgaacatatccaaatgcgctgacgtcggtccgatgaatacgatgtcctcttcttcacagcgtctcgcaaattggatattttcagagagaaatccgtagcccggatgaatggcatcaacgccgtttctttttgcgatctcaataatcccttcaatatcaagatacgcgtcaatcggttttttgccttcgcccacaagataagcttcatccgctttatagcgatgataggagcccgaatcttcttttgaataaacggctaccgttctgatgttcaattctgtgcacgcccggaaaatccggatcgcaatttctcccctgtttgctactaacactttttggatggattgttgtgacaaacttttctcccccttggcctaataaatatgtagtttataataaaggaatatccgccctgtgtatacacttgttttttagagatacacagatttttccgtctgccgtctttttacccctttagacggaacgggctccctctttttcttcttttctgagtacttgacatgcatgctgacattcaccaatataccggcgctcgtcaataacaaaaacattgatgatcccccgtagctgataaacggcagcggaacacctgtgatcggaattaaaccgctgacaccgccgagattgataaaggtctgaatcgcaatcatgctggatatcccgattgccaaaaggcttccgaacggatcttcacattttctcgcaatataaaaaccttttaacaccacaaaagccagcagcacaatgacaaacaggacgccgaaaatgccgagctcctctgaaataaccgccataataaagtctgtatgcgattcaggcagataaccgtatttttgaatgctttctccaagaccgagaccgaaaaaaccgcctgagccgatcgcataatacgaatttataatctgcagacctgatgtgctggcgtatttaaatggattttcaaggctttcaaaccggctcatacgcccgggtgtcaaaatatcgtcccatttcagataaatgatcgggctgataaggagtaatacgattcccgccatgagaaccagcctgagcagggtccttccgctgaatcccgaacacataatgacgcaaaacgcgatcagaccgataatcatcgccgttccgaagtcgggctgaatagcgataagcgcacaaatgactacggtgacgatcaccggcggcgcaacccccgtcaaaagctgatcgatgtagctttgtttctttgcgtacaccgcggcaagatacagtatcagggtcagcttgacaaattcccccggctgaatggccattccgccgattttaaaccagctttgcgcatttccggcaacatgtccgaaaacaaacagcgcgcaaagcgcagccactgacgcaagcagtatgattttctgaatcttttgatgggcgaacactttgtacggaaaaacggccgcgataataaacagcacaaaccccgcgatgacggcgaacagctgccgtttaaagaaatagtcgctgctcacgccgtaacgcataacagcggtaatcatgcttgagctgtataccattaccaatccgaaactgcacagcagaatgatagcgcatatcaatgaataatcgtaagattttaacattcttttaaacataacatcctctttcctgcttaaagcttacgtttaaaacctattgcgtattatattttactataattcataaacaatttacgcagtttctttatagtttttcggatgaaatgcagattaagagaccgtcttacgaaaagaagatgcaaaaaaacggtttacggttataaaaaaacccaaaccgttgaatagtttgagtttgatcatttattttcctgtaaacgcgtcatgcaaagcagacagttctctttcaagtctgtccagcagctctttgccgtcgttttcgtcaactaatcccaggcggacagcaaaatcgatttccctcgacagtccgaacatctgagtatccaagacctcttcatacagaggacattgaggcatcgttaagttatccatttgtactcggatcagcttcaaaatcttctcagcatctaacttcaacagctcgaatgctttctgctgatggtcaactataatctctgaagccaaaagtatccctccgttccccaggcgagtacctaattcttctatttatcataaagggtatcagatgaaattgcaagaggatttaagcagatgttatgataaaaaatgtttcaaaaaatactcagcctgtatttctcagacatgatttccaaaagcttcacacccgcgatgctgttgcctttttcatcaagcgccggaccgaatataccgattccgaagttgtacggcgaaatgcccatgattcctcccgaaacgccgcttttagcgggaatgccgaccttgattgcgaattccccgctcgcattgtacatgccgcatgtcaccataaacgtcttgcaaattctcgccacatcttttttaatgacctgctccccggtttccggatgcttgccgtcaagggcgaatacacagccgattttggctaaatccagactgctcatcttaatcgcgcactgttttgtatacaaatccatgacctcttcaacatcgcctttaaaaatgtcatactgcttcatgtaataacacatggcccgattaatcatggaagatttgaattccgattccgcgacatgtctgcaatatgtaatgtcctgattgttcgcaagtcttctgatgaatccgagcaggtaatccaggcggtctttcggcgaatgccctttaattaaacccgtaacgatgagagctcccgcattaatcatcggatttaaaggcttgcccggattcactgtttcaagcttaatcatggagttaaacgggtcgccggtcggctcctgacccacgcagctgaacaccttttcctttccgtaatccatcagtacgagcgccagagaaagcactttcgaaatgctctgcagcgtaaatgtccggtcggcgtctcctgccgtcagacatgtattttccgcatgataaatcgtgaccgaaaggctgtcttgttcagattcagccagagccggaatatagtctgctactttgccttcttcggttctttttttcgcttcctgaactaatgcgtccagctcttggtaatgccggcataccatgtcgatcatcctcacttcgctgccgttgtatacatctaatttgcaacgcaaagtgacaattcatgcgaaaacttttatactttaagtaaaggggggcttcaacatgagcgttattcaagtaaaaggcaatgttacatacccgattacaattgatccgagtgtctggattttcgatgaccgcaaatttccgtttgaaaacaatcagcctgttcatccggacggctctgcagaaacccaggagcatacgcttgatcctgaacgggtgatcagagaagggcgcatttcgccgccgactttaaaaagtgaaaaacgttatgaaaaagaaagactgatgaacggcagcttcgccatgaagctcggcgctgttttagcaaatgccgagccgaaagaaagcgctgtcctgtgcgcatttatttcaaaatcagaaagaaccgaagtgccgcttgaaaaggcgatggacgcaatcgcgcatttcagcgatgcggggaaaccgcttcaagacggcggtccggtccatttttacgtggacggagactttgaaaaaccgataacgggcgtcacagaaatcgaagttttataacaaatcggcggcaagctgtgcaaggccggatctctcacctttcacaagcttcacgctgccggagacggtttgtcctttaaaccgctctacaacataagcaagtccgttgtttaaactgtctaagtatgggtgatctatttgctccggatcgcccatcaggacaattttgctgccctctcccacccttgtcaaaagcgttttgacctcgtgcctcgtcagattctgagcctcatcaataataataaactgatccggaatgcttcttccccgaatgtatgtcagcgcctccacctgaatcgatccgattcctgccaaaatcgcttcaagttcacccggctttttcgcattgaataaaaattcaagattatcaaagatcggctgcatccacggcttgagcttttcctctttttcgcccggcaaatatccgatatcctttcccaccgggacgatgggacgcgcgacgatcagctttttataaataccgagatcctccgtctgcagaagccctgccgcgagagcaagcaaggtttttcccgttcccgcttttccgatcagggtgacaagcgggatatcttccctcagcaggagttcgagcgccattgtctgctggacgttcttcggcctgatcccccatacgtgctcatcatcgaaaacgagtcttttgacggtctctcctttcttatccgccatgccgaccgcagacgaagatcctcctaattcatctttcatcagcacaaattgattcggataaacctgatgctgctgaagctccttgactggaatttgtttgtttttataaaacgaggcaaaccgctctttattcataaatatatctttgtacccgctatatatttcatcatggtcaacgactctgtcgtttaaaaagtcctccgccaaaagcccgatggcatccgcctttaccctgacaagcacatctttgctgaccaggatgacgaggcggccgttttctttcgtttcctcctcaaggcttaaattttttgccaccgccaaaatgcggttatcattcgttttttcgataaaaatttcttggagctgatgaaatgaccggtggttcagttcaattctgagcgttcctccgctttcaagcggaactttctcgtgcagccttcctttctccctgagcccgtctatcagcttagatacgtgcctcgcatttctcccgacctcgtccatataccgcttttttgaatcgacctcttccagcacgacggcggggatgacaacttcgttttcttcaaaggaaaaaatggcgttaggatcctgcaaaagtacattcgtatctaacacataaattttactcaagtctcagcctcctgaaataaggatcaaagcccatcgtgtgcttctctttccgcgaaaaacggggatgcctgctaaaatatatgatttggtgaataaagatagaaggttaattcaacaataaaataaatgaaagcattcaaggagggaatctgacgtgcgaattcttttcattatcatacaagccttgtttatcctgaccggctgcactgctgtacaggacggccgcggccgcaatatccagaacgaatcaaccgatcagcgtgatgcaaaaccgattcatgtgaaaaatacggctcctgagacagctgaaaatcctggccggacagacatcgctaagcatctcgtcgaggtaaccgaaaaaatccccggcatttcagatgccaccgcggttgtactcggaagatactccgttgtcggaatcgatgtggatgacaatttagaaagaagcaaagtggagagcattaaatacaccgttgcccaggcgttaaaaaacgatccttacggcgccaatgccgttgtcgtggctgatcctgatacggtttcccgtctgagaggcatgggcagcgacattaaagccggccgccccgtttcaggcattttggacgaacttgccgccatcgtcggtcgtgtcatgccggaagtcccgaatgatgtgaccgacaatgaaaaagaatcaccgactcaatcgaatgatgatcagctgaaccaaagagaccagaacaagctgcagaacgaacagaacgatcaatcggatcatcatatgaaaaaccgccagtaaaaagcagcgcccgctccaaaagaagggcgctgctttctttccctttggcaggaggggcatccatgatataatgcttgtcatagtgaaagaggtgaaaatcaatgagagtaaaatgttccatttgcgacaaaatcgaacaaattgatgatgaaacactgacagccaaacgcctccgcaatcgtccgattcatacatatatgtgccgggaatgccatgaccgaatcaaaatcaaaacggaggcgcggctgaataccggacacttttcctttcatcctggacaaaaagcgaaaaaagataaactgaaaaaataaatcgaataaaaaatgacccgccggaaggcaaggtcatttttttattgcggtttagctgactggctttttttggactggtgcagacggattttgtaaatgatcaaaatcaaggcggcaacaacaagcccttctccgaccggcagaaacacaccgaaaaaagtcagcacggtgcagccgagcacgagaaagagataaactgccgcagccttcaaaaccggcagccgtttggcaaagccgagtttaaatacaatcaccgaaagcacgacgatcgttccgtataacagccacattcccgccagcggatgctcatccacttggtaaagagccgcaaagaacgacagccgttcacttacttcattcaaaaagatccccctccccttttccgttcgggttctaccttttcaaattctgcaagtgattaagacattcctgctgtttttttctttttcgccgctttttcacgttcgtttttattcaggattttctttcttaaacggatggattccggcgttacttcgcagtattcatcctcgtttaagtactcgagtgattcttcaagcgacataatgcgcgctttcttaatcgtagtcgtttgatccttcgtagcggaacgtacgtttgtctgctgtttcattttgctgacattgacaacaaggtcattgtcacggttatgttcgccgacaatcatgccttcatacacttctgttccgggctcaacgaagatgacgccgcggtcttcaataccttgaattccgtaagatgtcgcttttccgttttccatggaaacgagcacaccctgacgtcggcctccgacttggcctttttgcatcggctgatagctgtcaaacgtgtggttcaggataccgaaaccgcgtgtcagtgacagaaactcagtagaatagccgatgagtccgcgtgaaggtacggtaaagatcaggcggacctggccgtttccgttattaatcatatcaagcatttcgccttttctcgcacccattgattccataacagaaccggtatgctcttcaggcacgtcaatctgcacgcgctcaacaggctcgcagctgacgccgtcaatttccttaatgataacttcaggtttagacacttgaagctcatagccttcacggcgcatgttttcaattaaaatggacaggtgaagctcaccgcgtcctgaaacaacccatgcgtctggtgatgcagtcggttcgacacgaagactgacgtcagtttgaagctgcgcattcagacgctcttcaattttgcgggctgtgacatatttgccttcacggcctgcaaacgggctgttgtttacgacaaatgtcatttgaagcgtaggctcatcaatgcgcagaaccggcagcggctcatggtggtcagccggacaaaccgtttcaccgacgttgatgtcttccatgcccgaaacggcaacaaggtctcccgctctcgcttcttcaatttccacgcgtttcaatccttggaaaccgaagattttcgttacacggaatgatttaaccgttccgtcaagtttcatcaatgaaacctgctgacccactttcatcgtgccgcggaaaacgcgtccgataccgatacggccgacataatcattgtaatcaagcagcgccacttggaattgaagaggctcttcggcgttatctaccggggcagggacatgttcaagaatcgtttcatacagtgattccatgttttcgtcctgctttttcggatccagacttgccgttccgttaatcgcagaagcgtagacgacagggaactcaagctgttcttcgtttgcgtcaagctcgatgaacaaatcaagcacttcatcaatgacttcttccgggcgggcgaaatcacggtcgattttgtttacgacgacaaccggatttaagttctgctcaagggcttttttcagtacgaaacgggtttgcggcatgcagccttcatatgcgtcaacgactagcagaacgccgtcaaccattttcataatccgttctacctctccgccgaagtcggcgtgtcccggagtgtccaaaatattaatgcgtgtatctttatagttaatcgcagtatttttcgcaagaattgtaataccgcgttcacgttcaagatcgtttgaatccattgcgcgttcggcaatattttcgttggcacggaatgttccggcttggtgaagcaattggtctaccaaagtcgttttcccatggtcaacgtgggcaataatcgcgatgttgcgaagatcgtttcgaagtttcacattttcatctcctaaaaaaattagataactttcatattataccacacatcctctttaaaagcgttacgtttttctgtaaactgaaagtatgacgttaaaggggatggaaatatgaaaaaattgaattggctcttattattatttgcattcgcagcagtcttcagcatgatgctgatcggcgtatcaatcgctgagaaaagcgcatggggcatcatcggaagcattgttctcgttatcgccatgatgggaagcggtttcaccgtaaagaaaaaaatgcgcgaacagggactgcttgattaaaagcatgaccctttgcaaaattccgtaaacatggaaagacaatatcttatgaagcctgaatcaaagattcaggcttttttacctcctcaaaaacagactccagatgtaaggcttatctcccccgccgtctagtcaggaagccgggaatgacggcccccattctagttacatcagcagattccctcagaatatacagtctgaaatagtccggcatcgttatgcagaaaataccatacctcctatatcaattccatcattgtctttttatacttgtgactgtaagcaaatacacatgacaaggagagaatgaaatgaaaacatcttttttgaagaaaaccgctgtaactgccgctgcaaccgcctcagccgccttgcttgcattcagtccgcttgattctgccggcgcaaaaacgattcaggcaaatgaaccgcatgccctgcaggcttccgcagagaaaacaccggaagacacggcaaaactcattgacatcatcagccaatcgatttacgaaaaagacggcgtctattattttgacggtgaaaaagcggttgaattgggattagataaagaagccgcacagaccattcaaaagctgtgggacagttcaaccgaatttttaaccgttctttctcaatgtattgagaaaacggacggcgaatatacatttaataaagaaaaagcggtggagctcggatttacggaaaaagaggcccttatcgttgatcagctgttcaccgctttttcccaaagtcttcatatccttcaatctgcgctgattgaagaagacggtgtgtatacgtttgatcaggaccttgctgaaaaagcaggagcaggaaaaaaagaagcaaagctgtgtgccggattctttaattcactgcctcaggacttgcttgaaggcatttatacagcctttcatccggctgagtaaacggataaaacgcccggtcatgtcatgcagccgggcgtttttttaaatcagcagtttaaagatcagcatgataaagaaaacagcgccgaacaaacaggctgcttttatcagcagcttcccgtaataccgttccttaaaccgcctttcttcttctgcataacaggcgggctccttcatctcgggactgccgaggtcaagcggctccttcatcatatgatataaactttcgcacttaccgcatgattcaaggtggcgggaaataaaccgctccgtttctgtttcacaatcgccttcaatatataaagggagtaaatctctcactaaacagcaagtcatatctgtccgtccttccttttttccgccaagtgctgtttcagctgcattctcgccctgtacagagtgctcttcaccttcgaaagactccagtccaaaacatcagcaatctcttcgtaagacagctcttgaaatatctgtcgaaatgctgaataaaatgactgaaaatctctgacatctgaaacaatccttttcgtttattaaggcctcacctgtttagacaaacggctataaaaaaagttttacagatcggaacatttttcctctatcatttctcccgacttcatttgtcatttttttcagaataaatcgcatcattcgactcatgtttgattcaacacgtgcctctcggcttatcccctgacgctgcccgcctgaagcctttacgggacgattctatcaattcatcagcgaagtctagttttatattgcagaatgagagaatgctggtttattataacaatataagttttcattattttcaaaaagggggatttattgtgggtttaggtaagaaattgtctgttgctgtcgccgcttcctttatgagtttaaccattagtcttccgggtgttcaggcagctgagaatcctcagcttaaagaaaacctgacgaactttgtgccgaagcattctttggtgcaatctgaattgccttcagtcagtgacaaagcaatcaagcaatacttgaaacaaaacggcaaagtcttcaaaggcaacccttctgagagactgaagctgattgaccacacgaccgatgatctcggctacaagcacttccgttatgtgcctgtcgttaacggtgtgcctgtgaaagactcgcaagtcattattcacgtcgataaatccaacaatgtctatgcgattaacggtgaattaaacaacgatgcttctgccaaaacggcaaacagcaaaaaattatctgcaaatcaggcgctggatcatgcttttaaagcaatcggcaaatcacctgaagccgtctccaacggcaacgttgcaaacaaaaacaaagccgagctgaaagcagcggccacaaaagacggtaaataccgactcgcctatgatgtaaccatccgctacatcgaaccggaaccagctaactgggaagtaaccgttgatgcggaaacagggaaagtcctgaaaaagcaaaacaaagtggagcatgccgctgcaaccggaacaggtacgactcttaaaggaaaaacggtctcattaaatatttcttctgaaaacggcaaatatgtaatgcgtgatctttcgaagcctaccggaacacaaattattacgtacgatctgcaaaaccgacaatataacctgccgggcacgctcgtatcaagcactacaaaccagttcacaacttcttctcagcgcgctgcggttgatgcgcattacaatctcggcaaagtgtatgattatttctatcagacgtttaaacgcaacagctacgacaatagaggcggcaaaatcgtatcttccgttcattacggcagcagatacaataacgcggcctggatcggcgaccaaatgatttacggtgacggtgacggctcattcttctcgcctctttccggttcaatggacgtaacggcccatgaaatgacacacggcgttacacaggaaacagccaacctgaactatgaaaatcagccgggcgctttaaacgaatccttctccgatgtattcgggtacttcaccgatactgaggactgggatatcggtgaggatattacggtcagccagccggctctccgcagcttatccaatccgacaaaatacggacagcccgaccattacaaaaattatcaaaaccttccgaacactgatgccggcgactacggcggcgtgcatacaaacagcggaattccgaacaaagccgcttacaacacgattacaaaaatcggagtgaaaaaagcggagcagatttactatcgcgcactgacggtatatctcactccgtcatcaagctttaaagatgcaaaagcagctttgattcaatcagcgcgggacctttacggctctcaagacgctgcaagcgtagaagcggcctggaatgcggtcggcttgtaaacaagaaaagagaccggagaaatccggtctcttttttatatctgaacatttcacaatggcttcaccatgatcatatatgtcttttcccgatcgtctttttcaagcttaagctgttcaaagccgcattggcttaaaaacaaaacccattcctgcctgtccaggggaacggctgaaaacatcgctttatgctctcctctcagccggcccgcaatctcttcaatgaccgcgcgaccgattcctttctcttttgcctccggagcgacggccacggttccgagccacggttttccgtttgaaggcgcccattccaaatgaaaactgacggcggcaggagcgccgtcaatctcccatacgagccacgttccattgtacatggagtatgcaagcataaactccgccgcattttttgttccgaactcttcgtttttccacaccgggtgtgatgccgccagctgctccagaaacccgagatcttcttcttcaaaatctctacctgtcagcatgtaaatagtcgtcaaaaataattttatgtatagccggattgcccgcaagcacgctgtggttgtctaaaaacgtgaacggttcgccgtctgtggtcgtgtaaatgcccccgacttcgttcagcagcacgcagccggcagcgtaatcccacggcgcgagcctcatcgtaatgtatgcgtcaatgcggccggccgcaacaccggccagctcaagtgccgccgaaccgtaggaacgcgttcctctgacccgttttacgagcggcgccaaaatactcgggtcaatccttctgttttccgtcacccatgtggcattgattgcaataatggcttcttcaatggaagcttcttttaaaggagcaagcggcgtatcattcagataagccccttttccgctgaatgcgtgatacagttcgtcctgcatcacatcataaattaagccgattttgccttttccgtcttcaaagatgccgatggagatcgcgaaatgccgcttttgatggacaaaattcatcgtcccgtcaatcggatcaatgatccagacgattccgtcaagggagcggagtttatccccctgcccttcttctccgagaatccggtgtccgggaaaagttccttgtatacggtcaatgaaaaagcgctccgtctctttatcaatatttgtgactaaatcattcggatttgattttgtttcaatcgtcaagctttcctgcatggattgtctgattctcgttccggcttcttttacccattgttttgcgatatcatcaatttccgtccaatttgtcataccgtgtacctcttttctatgtatagcttattctatagcatactgataaaggcgatgaaaaagcaaggaaaatgaaaaaaatgccttctcacgtaaaaacgaaccatttcctgcggttcgtttttactattctttatccgttaagccgaatccattcttttctgagacgttccagttttcttttgctgagatcgatttgatcttcattctctttttgcatggcctcgtacagggttgccaattcataatcaacctctagtctccagacagctacacggttatttttttcctccctgaatccttccttcaccacttgcctcattgtctttcgccccttccagagatcatttgttaaaaaagcatcccatttttccaattcattaatgatacttcttatatcgtatggaaacttatattcggctgtaacaacattcttaaaattgtgtgtttacctattcgttttttaccaccattcctctcggctcaaacgttctcaatgtttttgcggcgggcggcggctgtggtaaaatatgaatacttacgttaaggaggaaaaagatgactcagatgcgttttacaaaagaagacttcgatacatttacaatagaaggtttagatccgcgcatggaggtgttaaaagaacaagtccgtccgaagctgaccttgttaggagagcatttcgcaccgacattgtcagcattgacaggagatgaaatgttcccgcatgtcgccaagcacgcgagaagatctgtcaacccgccggctgacagctgggttgcctttgccaacagcaaacgcggctataagaaactccctcactttcagatcggtttatgggacacccatatgtttgtatggtttgccatcatttatgaatctccgataaaagaggaatacggcagattgctggaagcgaagcaggaggaaatcacaaaacagattcccggccattttgtatggtcgccggatcatacgaagccaggtgcgtacaagcagtccgacatggatcaggagcagctgaaaacattatttgaacgcctgcagacagtgaaaaaagcagagcttttatgcggcattcagctgcaaaaagaagacgtaatcaacatgaacaacaatgaattcctgcaaaccattgaagatgcttttaggaagctttcctttttatacacactgactcagaaagtctcataacataaaaagcgggccgattgccggctcgcttttgtctacattttgataatcgcttgatctgattgtttcgcctgtttcacagtccgatacggggaataggtgctgtcagcttcaaattggctgcagattttcttttcttccgctttcccgggaacgatttctttaaagcggcggtacgcattcagaagtctgtctcggtcagctcctttttcataggcgttttccacctgctgaaaaaaagcaatgacatccacggcctcctctgtcgtccagtcctcattcatcggatattgatattccaaatgtcttcactcctttatcatcatgctcaaaaataagcatcttccatagatcataaattgttctttactttctttcaagttcataatataattcatttgttttacgtttaaaaaacgggtaataaaactgaatgtaatacaaactaatccgtaggtattatgataaaggtgggaaaacaattgccgcaacatgaaacacccctgtacagcggactgaaaaagcacgcggacagacagcctgtccaattccacattccgggccataaaaaaggcgcgggaatggatccggaattcagacaatttatcggagaaaacgcgttaagcatagatttaattaatattgaacccctggatgatttacatgcgccaaagggcatcattaaagaagcccaggatctggccgcggaagcattcggcgcagaccataccttcttttccgtacaagggacgagcggcgccattatgacgatggtcatggccgtatgcggacccggagataaaatcatcattccgagaaacgttcataaatccattatgtcggccattgtattttccggagcggtgccgatttttatacacccggaaattgacgatgagctcggaatttctcacggcattacgcttgagtccgccgagcgggctttgacggaacaccctgacgcaaaaggcctgcttgtcataaatccgacatacttcggtgtggcagctgacttgagcagcattgtaaagctcgcgcattctttcgatgtgcctgttcttgtcgatgaagcgcacggcgtgcatattcattttcatgataagcttcctctgtccgccatgcaggcgggcgctgatatggcagccacaagcgtgcacaaattgggaggctccctgacgcagagctccattttaaatgtgagagaaggccttgtttccaaagaaagagtacagtcgattttaagcatgctgacgacaacgtcaacatcctatctgcttctcgcttcactggatgtcgcaagaaaacgcctcgctacagaaggccgcgatcttcttgaagatacgattctgctggcggatcagacacgggaacgtctcaatcaaattgaaggcatccgctgtgtcggcgaagaaatcacagggtctaaagctgccttcagttatgatccgactaaattaatcatttcggtcaaaaacctcggcctgacgggtcatgacgttgaaaaatggctccgcgaatcatttaatatcgaagtcgagctgtccgatttgtataatattttatgtatttttacacccggagacagagcaggagatgccgaccgtcttgtaagcgcgcttacagacatttcaaagcaggcttccgcaaatgattatgctcatcagcaaacggaagttctgcttcctgagattcctctgttagcgatgacgccaagagacgcgttttacgcaaatacggaagtcattccgttaacagaatccgcgggacggatcattgcagagtttgtcatggtgtacccgccgggaattccgatctttattccgggtgagatcattactgaagaaaatatcagctacatttttaaaaacttggacgccggccttcctgtgcagggtcccgaagatgccacgcttgaaatgatcagagtcatcaaagagcaaaaagccatccaataaacataaagaagcccgaaacgaaatcgtttcgggccttttttacgctttttactcttcttcaagatgacactggcattgtccgcagcatgttccgtataacgtcgtgaccttctcatcctcaaagtaatgaatcgcttcgttacagtcttggcaaacaattgtacccatctgtcattccccatttctcagaatttgaaaacgcttaatttttacttgttgttattatattattatgtcacatttaatatgtcaactgataaattgtataacacatttattttttacggtctttttatagctcgagggtcaatcacggtatatcctttatgacgcaatccttttacaatgtccggcatggcttcagccgtccatttccggtcatgcatcaatatgttggcgccgtcccgcaggtaaggactgctcagtgtgatatcggtaagcgcttttttggattgatatttctgatcccaatcatacccgaaggtccagttcattttcaccataccttctttttttataagtctgtcactgtagtccgtattgcttccgaaaggcgccctgaaaaatgcgggtttctctcctattaccttttcaaccgctttattgacgccaatgatttcttcccgttgtttttgttcggaaagatcttttaagttttgatgagtcattgtatgatttccgatcataaaacctaactcatgaatatgcttaagcgctttcttattttcatcttttttcaaaaaatgtccgtttacaaaaaagatcgctgacgcattgagatcatgcagtttgtccgcaatctcagcggcatgctgatcaggcgcgtcatcgatcgttaccaatgcgatcggttttttctctttctgttcatccattttttccacagaaaaggttttcggattgatatagtaacggggctccgccttctgttttttctcttttgtatgatggttttcccgtttggcatgattggccgcggcttgagaatggggtttgtttgtttgcagcttttcatttgattggcagccggcgagtaagcacatacatatgacggctgcaatggctttatacatgcaatccctcctgatatggttttgcccccagtataacgaaaaaacagcgctctcacgaaaaacaatgtgccttttttacacatcggctgtgcaagttgtcacacgtattatttcttcattaaaaacggtttcaattatataacaattcagtaacaagccttaggtttttcacctctcgtgatacacttgatatagtccttataaatggatgaaccaatatattatataaaacagaggagtaagatagatgcgctaccgtacggtgattcccttttttttgatgctgttcgttctgtcaagctgttcggtttctactgtcattccattcaaaaataaccggatcgacagcattcatcacactcaaatcttgtttttttccgatgaaaatcatatagataaagaagttccttattacgatgcgattcttgatttagaaaagaaatatccccatcatgtcgatcaaatgaaggtttatgacaacagaaagggatgggaagaggaaatcaacacgttccctgcgctgatggtgatcaatcatcggcatgtggtcatgaagattgagggatccgtaaagaaaaaagaggatatcatcaaacctatgcagcatgtgcttgcacaataaaaacagcccccgcttttataaacgggggctgtttctttgttacatcattattttacgatgtggatcgggcttccgattgctacttcggcagcttccatagtgatttcgcccaatgtcgggtgagcgtgaattgtcattgcgatatcttcagcagtcattccgccttcgatcgccaggctcaattcagaaatcatgtcagaagcgcttgcgccggcaatttgcgcaccgattacaagaccgtcttctttacgggtgatcagcttcatgaagccgtcagtttcgttaagagacagcgcacgtccgtttgctgcaaacgggaacttagctgcaacgacttcaatgccttcttctttcgcctgtgcttcagtgtaaccgacagaagccagttcaggctcagagaatacaaccgccggaataccgaggtaatcgatttcagccggctctcctgaaatagcttccgcagcgattttaccttcgtaagacgctttgtgagccaaaggaggtccgtcaatgatgtcaccgattgcgtaaatgttcggtacgtttgtgcggcactgcttgtctgttttaatgacaccgcggtcagtcatttcgataccaacttgctcaaggccgagctcatcagtgttcggacggcgtccgacagtgattaatacgtaatcagcatcaaccgttttttcttcgccttttacttcgaatgtaactgttacgccgtcaggtctttcctcaacgcctttagccatggcgcttgtatggatttcaacgttgccttttttcttcagtctgcgggtaacgagagaactcatttgtttttcgaagccaggaagaatttcatctccgccttctaaaataaccaattcagttccgaagttcgcatacgctgttccaagctcagtaccgatatacccgccgccgataacaacgagctttttcggaatttctttaagcgccagtgcgcctgtagagttcagaacgcgttcgctatatttgaagtttggcaattcgataggacgagaaccggtagcaatgatcgcgtttttaaatgtgtatgtttgcgcagagttctcatccattacgcggacagagttgctgtctacgaaataagcttccccgtttacaacgtccactttatttccttttaaaagacctgcaacaccgccggtaagcttatttacaacagaagctttccattcttggacttttgtaaagtcaaccgttacgttctcagcagtgattcccatgtcatctgaatgttttgcattctcgtaacgatggcctgcattgatgagcgcttttgaaggaatacagccgacgttcagacaaacgcctccaagagttgctttttcaacgactgttactttttgtccaagctgagcagcgcggatggcagctacatagccgccgggtcccgcaccaatcacaagagtatctgtttcaatagggaaatctcctactaccataacattacgcctccattaaaataagttgtggatcgttcagtaaacgcttgatgtggtttaacgcattttgtgcagttgctccgtcaatcatacggtggtcaaagctgagagaaagagctaagacaggagcagctacaatttcaccgtcacggacgatcgctttttcagcaatacggccgataccgagaatcgcaacctctgggtggttgataaccggtgtgaaccattggcctccggcagaaccgatatttgtgatcgtgcaagaagcgcctttcatttccgcaggtgcaagcttgccttcacgcgcttttgtagcaaggctgttgatttcatcagagatttcgaaaacggctttacggtcggcatttttcactaccggcacaagcaggcctttttcggtatccgctgcaattccgatgttgaagtaatgtttttggatcacttcatctgttttatcatcaatcgatgtgtttaaaacagggaattttttcaaagcggatgttaatgctttgacgacgtaaggcagataagtcagcttgatgccttgatcagcagcaacttgtttgaactgtttgcggtgagcaacaagatttgttacgtcaacttcatccataagagttacgtgcggtgcagtatgcttagagttcaccattgctttcgcaatcgctttacggataccgctcattttttcgcgtgtttcagggaattcgccttcaggagcctgagccgctgcaggtttagctgtttcctgaggtgcagctgtttcttgcggtgccgcttcttgagccgctcctccatttgcaaagctgtcgatatcttcttttacaacacgtccgttattgccagaacctgttactttacggatatccacgcctttttcacgggcatatttgcgtacggaaggcatcgcgatcacgcgtttgttcggatcagcttccgcttggtcctgctgtcctgcgccggtttcttttgcaggctctttaggagtctcttctttagagatatcctgccctgcttcagcagacgactgaacttgagcctcagttttcgcctctcctgaatcatggcttcctttaaattgaagatcttcgtaaccaggtgcgtcaaacgtaataatcgtttgtccaacagttgcaactgttccctcttcaacttttaattctaatacttttcctttaacaggtgaaggaatttctaccactgctttatcattttgcacttcagccagaacatcgtcttcttctacctcgtcgttcggcttcacaaaccattttacgatttcgccttcgtggataccttccccgatatccggaagtttaaattcaaatgccacagttttcgacctcctagttgattaagcaaattttagttatgcatacgcaagcattgaacctagtaaacagactccttcatcataagagaaaaggactctctttaccgtcttttaagatgcctgattaaaattcaagaacttttttcgcagtttcaagaacgtctttatggtttggaagccatacgctctcagcaagcgagaaaggaaatactgtatcaggcgccgcaacacgcagaaccggagcttccaggctcagaatcgcgcggtcattgatttcagctacaacgttggcagcgatgccggcttgtttttgagcttcctgcacgacaattgcgcgacctgttttttcaacagaagcaataatcgtatcaatatcaagcggacttacagtgcgaaggtcgataacttcagcagaaacgccttctttttcaagctcttcagcagccttaagcgactcatgaaccatcgcgccgtatgtgatgatagaaaggtcagtaccttcgcgtttcacatcagctttgccaagctcgattgtgtattcctcttcaggaacttcctgacggaaagaacggtaaagtttcatatgctctaagaaaacaaccggatcattgtctctgatagaggcaatcagcagtccttttgcatcgtaaggagtggaagggataacaactttaatacccggctgctgagcgataaggccttccaaactgtcagcgtgaagttcaggtgtatgaacccctccgccgaatggagaacggattgtcaccggagaagtccagcgtccgccggaacggtagcggagacgagccatttgtcctgagattgaatccattacttcatatacgaatccgaagaactggatttccataacaggacggtaatcttgcaggcctaaaccgagagcgagaccgccgataccggattcagcaagcggcgtgtcaaatacgcggtcctcaccgaattctttttgaaggccttcagttgcacggaatacgcctccggcaacgcctacatcttccccgaaaagcagaacgttttcattgtttttcagttctgtgcgtaacgcatcagtgatcgcttgaatcattgtcatttgcgccatggcttacttcgactccttcgctttgtaaatttcaagttgttctttcaagttgaacgtcggctcttcaaacatattctcaatcagctctgttactttcggttttgattcgccgtcagcctttttgatagcttgtttgatttcttctttggcctgttcaatcactttgttctcttcttcttcagaccatagtcctttgttttccaagaacttgcggaaacgtacgagcgggtctttttgctcccattcattttctatttctttcgtacggtatttagtcggatcgtcaccggacattgtatgaggtccgtaacggaatgtaagagtttcaatcagagtcggaccttcaccgttaattgcgcgctggcgtgcttctgcggttgcagcgtaaacggctagtgcgtccattccgtctacttgaacacctgtaataccgacggcaactgctttttgggcaattgtctgtgcggatgattgcttttctacaggagttgaaatcgcatagcggttattctgaacaacgaagatcgccggcgctttaaatgctccggcaaagttcattccttcatagaagtcaccttgagaagctccgccgtcaccagtgtaagtaatagctaccgcttttttaccgcgctttttaagccctaaagctacacctgcggtttgaataatttgagcaccaataataatttgaggtgataaagcgtttactccctcaggcatctgattacctttaaaatggcctcttgagaacaggaatgcctgatgtaaaggaagcccgtgccaaatcagctgaggaacgtcacgataacccggaaggataaagtcgtcctgttcaagcgcgaagtgtgatgcaatttgagaagcttcctggcccgctgtcggtgcatagaaacctaaacgtccttgacgggaaagagaaattgaacgctggtctaaaatgcggatatacaccattcttctcattaattcctttaactgatcatctgaaagatcaggcattgcgtctttatttacgacttctccttcagcatttaaaatttggaacgtttcaaactgcttattaatagcatcaaattgttttttgctatcaacaattgaagtttttgtctttgcagccattttttaaaccacctcttcttttgatttaacagggttaggataccgtttagccatccgtattaaaaacagtcttatcatgctctgcaattctaaaattaatcattcagaaattcacatagcgcttaagcaaagataatgacgtttaaactgtactaataaaaaaagattttttattagtacaatatgatcaacaaccatagtttacagtaattaaacaaagccgtcaattatttataaccttattttgaaaccgcttataaaacttaagatcatactgcgtcaaactgtactataaaagactttaaactgtattataaaaacgctctactgtactataattaaaaaaaattacaaagagtaaattaagttatttaacttcgagggcgggctttgagaaggtgccgcgggataaaaacgggcagttagcaatcgtcccgcctgccggacaggcgggacgatgcttttgtctaattattcaatacccgcccacacgatattcagcggcgtcagcacggcatgaggatgaaactcggaaatcggagtgaaaaatacatacgtaaaatcttcggctggatcagaaaacatgccgcaccaacccattccaagatgtgagaaggtgccttctgtcatgaaataatggtcaccggccggccacaaattaatgcctaaaccaaagccgccctcctctctgggcgctccgaagaagtaaaaaggaagaccgggctttatttgatttctcagcatggcctcgactgtttttcttccaagcagcttcttatctttcaatctgcctttatttctaaacatttcagctaacttccaaatatcttccaacgaagagtacagaccgcttgtcgctttattcggaaaatacgggtgatgacttttttccagctgtacacactcgtgctcattgatcacacaaacttcttcttttaaagcatcaggcacataaaaaaacgttctttctaatccgagtgcttcaataatatgctttgttacatactgttcgtaggacacgcctgttacttttgaaataatgatgccaagtataacaaagccggttctggaatagttccatgcttcatccactccgtactctaaaggcgtactgaccagatagcttatccattcttcctcattcgttaagtcaatgccttcagccttttgaatatccagctcaaaacttaatcccgccgtatgagtcaaaaggtgtaaaattttaatgtctccgaaacccggtttatcaaacgcaggcaaaatgagcttgaccggcattttcagatcgagcagacctttttcgacgagctgcatgacggctgcagcggtaaacacttttgtcaaagaaccgatttctctgattgtatcaagctgaaatgtttgcttttctttttgtccgccggtaaattcccctaacgactcagctgcaaaaacctcgcctcctcttgatatcatataactcgcacattgcagatctccattgtctatcatcgactgataatggctgttaagagcgttaatttgtttcatatcaaatgccggattgcttattgtttgtttcattgttttctccccctgtactgtatgtatcgttttcatcccttacttactgatttcttgatgaattctgacaccgctttattaaattcttccgggtgtgtgatgttcggaagatgccccgctcccttaattttctttaattctgcattgctcagcagtttcttcagcctttttgtttctttctgatcaactacgctttccttctcacccgtaaggataagcgttcttgtatgaatgtcttttaaaaagccgatcgtagaatagccttcttgttgatgtatcttcataaaacgttcaatagaagcatttaagaattgattcctgtataaactttcatattcatgcgattttcctatagctataaaatcatttttcagtttttcctcaacactgctttcagggtcttcttcgtattcggtgtaacttccggaaagaatgagtgtttttactttttcagggtattcataggctatcctctgtcctatcatgcctccccaagaagctgccgcaatgtggatcggccaagcaacccctatctcgttcagtacttcaataaaagtctgagccagcccgctcagtgtaaaatcggcgctcccctcactcagcccgtaacccggtgtgtgtatgacaattacattaaattggtctgcccactccttcatttgttctttccacatgtaagcagtggtagcaaaaccgcaaatcagtaaaattgtttcacccttgccgctcatcaatatttccatatgccgggcattttctgtgttagccagaaaatgaacggtttccgtttctcctgtctggtaaaaagcgatgagtttttttgcggcatcgctttgatcgtgctgaagggctcctttcttcagtctgctccaataatgcaaataatcgtcgagatgacgattggaagctgtgccgagtattcggaaaggactttcagcttcttcttccgtaacgattgacgaagcatcaaaatcggctgcaatcgctgaatctcttactaaaggcggtgctgaacgggcggataacggattgaaatcattttgtattttttctttttctccgtataacacgatcagctggtggccttggccgagaagcgagtgttcaaaagctttgattccggcagtattttctaatgggtgcagtccgtaatcggttttcataatgtcttgaatgccgggatcaactgacatgcctccgtctttccagaaaggccaatttacagcgatggtttttcctgatctcccctcctcctttctcatacattccctccactcggcaaaatgctccagaaaacgattggcgtaggcgtaatcggcttgacccagacttccgatttctgaagagatggaagaaaacaaaacaaaaaagtctaaaggcatatttctgagcgcttcatccaaatgaatcacaccattgacctttgattgcagcaccgcctgagcttccgcgtctgttttattcataatgaaagagtcttttaacacgcctgcactgtaaatgaccccgttgatttcggaataatcagcatgaattttttccgctaaattgatgacctgctgtttatctgacatgtcagcctggatgtaagaaatgtttgccccgtcatatcggatgctgtctaatttttcttccatttctgctgtcattttcgatcgtccggcaatgataacgttggctccgtgatttgcataaataaacgctgaaataatccagccgatgccgcttaaccctccgatgatgagatacactccgttttttacaaactttgcggccttttgccctggttgcagcgaagcatctttgtatgctgtcacccgccttttttgatcgccgtcatatttcacagcctcatgatgtccggcacttaattcattgagaagcaaagatgctttttcaatggtttgtcttgaagaaatctcaaccgttttacactttatattcggctgctccgcattcagcgttttaaaaaagcctccaatcgcggcgtaaatcggatttgtatattgatccttgtcatgtacgtacaaaaggttgatgttatcttttattttttgacggatcaacgctttgcttaaataaaggattgaataaaagctgtgagtcaaatctaacgctgcctcagtataagcttgttttgacaggtaatgaatgattgacgccggaaacgctccggactttttcatatcatctaacagtctggtgtaatgagcagactgctccggattaaatttataatgcttttcatttaccatttcatattcagcggcggcttccgcataaataacattttcactgccgatgtactttcggatttcatcactcaatgaactgccgaaatcgaaaatcaatgtattttccttaggcacttctccggactttaatggcgattctatccattctttttgtaaatataaagattcaagcatcggcttttcagacggctctttcgtttgcgttttttctttaaaagctgcggccggcgtattacgcacatcatatttttcttctaaataagctgctaaatcatgaatattgttataatcaaaaagcaatgtcggatacaattgtgtatccaatctttcctcgagcattttcgatatatgcagcagctgttttgagtcaagacccagttcgtaaaaagattggtgtttgtccgctttatttggcggcgtgtttgtcacatctccaataatggatgacagctcatctgttaatgttttttgactgtcttggtgctgaactgtatcagagatagagtctgtaacgcgagctccgtatttctcctgcagatattccgtcaattcaccgattgtggagtaatcaaataataaagtcgggtacagctttgaatctaacaacagttctaattttttagataagtctaataattgtttagaatccaagcccatctcgtaaaaggaaatatcattcttcaccgtttcagcaggcttttcaatcatgccggctatctcttggattaaattatttctgatcatttctttattgttcgttacgctgccgacctctttagctttttgggaatgctccagcctttgtattgatttttcatttctgactcttttcacaccgaatcgctcataataaaaagcaagctctccatcaggcctgtatacttctatgtccgcatataaaatgtctttagaaggcggctgcgttatactgtttttatcaatatacacaaaacaagacccggttgttttatgcagtgcccggaatgtctcaatatatatagggataaacgcatttgttccttcatccggcaagtctgatgtaaggactcccaacaggctgagagatccatccaaaaatgcggggtgcatgtaaaagtcatctgtatattcttttgaaagtccgcttaaactgacctctcccagaatataattttcaccttcatataccgtaccttccaatttcataaaatctttatgaatcaggccgcccctgcgcaaattacgataggcggcttcagcatccgaagtccggacggcccctttctttaatgcttcgattgaaattgtcttttcgtttatcgcattttttcttatgatttccgcctgcaagttgactgacgcttcaccttccgccttttcagcgacccatttcctgcttgttgtttcaacaagccagccgttttcttgttccgtaaactggaaggtgacttttttatcaaaatggactgacgtcgcaacaggttcacggaataaaacatgtttgatttcaaaacttcggggtgatatccctttctcagctaaaaatcgtgttattaaatccagatacgtgacgccgggtatcgtacgcacttgatgaaggacatggtctgaaacaatataatcgtcatgtttgactaatacgctgaacctcatgcaactcgacaacctttcttcttttacaaagtaaagaaacagagcaggtgctactctgtttcatcaataatttcaagaagccgttttttattctgtttgatttgtttttttcgatttgaatccggccagtactcttttctgacaaactcggcaggcggcagcggagttctgacggaatgatatgaatcatccaggccgcttaccaaaaggtgggcgtttgttccgccgaaaccgaaagcgctgatgcccgccctccgttttccatccttccagcttctcagttctgtattcggataaaaaggcgacttttcaaattcaaagcggggatttggcgtttcacaattcaatgtaggcggaatttccttatgccatattgataaaatcactttaatgaaacttgccgctccggcggcgcttaataagtgtccgatattggtttttacacttcctactccgcaaaattgcgttttgtttgtgtctcttcggaatacttttgtcagagcctgaagctcaatcggatctccaatcatcgtgcctgtgccgtgagtttcgacgtagctgactgatccgggagtgatatcggctttttcaaatgcatcttgaataacctgctcttgaagcttaggattcggagtcgtaattcccattgtcgcaccgtcgttattaatagctgatgcttcaatgataccgtatatccgatctccgtcagcttttgctttctccagcggttttaacagaacagcgccaaaaccctctccgggtacaaagccgtttgccctttcatcaaaagtaaaacactgaccgtccggcgaaagagctcctccttctgttaacatcagataaggaatttcatccaaaagcagatccgcccctcctgccagcgccatttctgaatcaccgttttttatgctttggcaggctaaatgaatgctgactaatgaagaagaacaagcggtatcagacaccatgcttggaccgtgaaaattaaagaaatgcgacacatgtgaagcaataaagttttgactaagcccgacgatgtggctgctgctttctttcggcagtttgtgaccgtatccgcccattctggaaccgacaaatacgccgactttttttcccgataattctgtttcttcataaccggcatcccgtacagtctgtacactcgtttctaagaaatgtcttatcagcggatccgtttggatggctttctcctcttccatacggaaatactccggatcgaagctgccgattccattgataaatcctccccatttgctgatgctttttcccttttgctgcaccggagagtaatgttcttctatattccaccgggaatcaggtacttctttaatatgattcttcccttttctcagattgtcccaaaattcctctttatcagccgcgcccggaaacttacatccgattccgataacagctatctttgcagaggaagccgtctgcggttctgtatttcggctcgtcacagactgcatatcatgctgattgctgctttgagaatcagtctgttcgatttgttttttcaacggcggcgccgtcttaccgatatattccgcgagaccatgaatcgtgttgtgttcaagaagcacagtagggtcgatttttttctgaatcattgcttctatacgatgtataatgctgacaagaagtatagaatccacaccgtattcctgaaaatccgtatttgggttaagcttttcaaggggtatgctcaattcctcagcaaatacggcagaaagttcactgacaagcccttctgaatgatcaaaagtgccgggagtctcctgtcttcggaccggaaatgaagccttgccggttttattgatgttcaggagactgtctgcatgaaacactgttccttttttcacgataggaatgatattggccgattttttctccagtgcatgatacaaaatcgccagtccttcccgcgtggatagagagtccaatcccaattcatcatataaaggactcgtcacagtacccattccgacttctttccagctcggccaattgatggacgtgaaatacgttctccccttttgaaaatgataagccgcgaaatagtccatatatgcatttgcagacgcgtaatcagtcattcctttcgacagtttgggtgactgtgctgcaattgatgaaaacagaataaagaaatccagcggcctattattaaaaatccgctccaaattctgaagtccagtgactttcggcccgtacaccgtcttaaattcactcattcttttatgaataaaggccggatttccgccgctgtgcagtccggcacagtgtatgacaccgctaatatctttaaattcaaggcttacttggtgaaagaatgaacgaagcttctcttcatttgtgagagaaccgctgtaatacagatagtcgacacctttttcttcaaaactttgaaacagttttatattgctgactgtcttttcgtcctgtctgccctctttcagcaaatgatcccattcacttcgcaaaggtaatggacgcgtacccgtcagcacgagttttttcactccccgtttcaccaaatcttcagctattgctctgccaatgccccctgtcccgccggtaatgacgatggctttatccgcaggaaatgaaacaggaccgccgccggtatggattctttcttcttcaaaatacggaacatatctgacgccgctgcggtagcatacttcattctctcctgtacattgcgccctttcaatctcaaagatttgtttcagcttatgcgtttctttcatgctgtctatatctattgttttcacatgaacaaagccgtattccgcagaaagggctttcagaaaagccgctgattctgcacccgtcagctttggtttttccgctttaaatacctgcaagccattggttagttgtaaaatggataatggtgtttcctttttactccgcttaattatttcttgtataaataagaatttaccatatgggatgccgttctgattttcactctggtttccgatatctgagaaatcaaatatattttcgacctgccgctcaccgcccgagaagatctcacagataacgtcgtatgcgtggttttcatctaataaagaacactcaaacatttgatcagagtgttttataaatgaagagtgatgttttatgacaatcagattctcctgatctatatccggacaaatggtgcgggcaattgattctgtgtcttgattcacaaatgcgactgtcagtccgtactcttttgtttcggatggatttataaacggattctccctccattttttttgcaagtgatattgagaagaatgctgagggatctctgtcctctcagtcctggacggaacccaataacgttcttttgcaaacggataagtcggaattgagatccgtttacccggctgctgtaaatgatgaacggatttccagtcgatatccgccccccaaacccataattgagccagcttttccgcttcaccgttctcaataatggtctttacaaacaattcgcctgctctgccttccgttaacgccttcattttttcagcaaatgcatctgattgctgattaacatatacgcctggaacttgcttgtcaccgcggcaaaactgagataatttatctttcatttctttaagagaggtaccggtaatcgccgctctggcctccatcgcttctctgcccgattgtgtagtgtatgccagatcccgtaaaacgacgctttccgattggccgccttccatcacttcattcgggaacatgtctcttatcgctccggcatattccttcagtaagtattcagtaaccgcttgaatggaggggcaatccgttaattcatacatcgtgagttcaatatgaaacatttcgttaataaaatccgccatccggcttaattccaaaggacctacgccaaattcactcaggtgatcagaaatattaatttcttccggatgaatatgaagcaattccgaaacaaacggtttgagtacttcattcaccttttctttcatatcaggctgtttatcctttacttcaggacttagtgaacgctgaataaaatctttcatgttttcggcatactcaagaagacgttcattgtctttggcagataacaggacaatatgcggttcgttctcaacatgttctgttgagacgtttgtttcttcatattcttctataatgatatgaacattcgttcctcccgctccgaatgagctgattcccgctcttctcggaacagttactgtttttccgttttcctgcagtttcggtttcttccagtcttgcaatgaccgctgtacataaaagggagatgctttaaaatcaatatttggattcaacgtctccgcatgtatggaaggaaacagttttttcaatttcatttgcaaaagaacctttgtcaaaccggcaattcccgctgcggcctcaagatgaccgatatttgatttgacagaaccgattgaacaatattgagtgtgctccgtaaattcccgaaacgcttttgttaatccggtgatctcaatcgggtctcccagagaagttcccgttccgtgagcttcaatataactaattgtacgagggtcaatacaagctttctgaagcgcgtcctgtatcagttcagactgaccatttggattaggaaccgtaaaaccgtttgttctccctccgtgattgactgctgtcgctttaatcagcgcataaatatgatctccgtcccttaccgcttccgccgccggctttaaaagtacggagcccactccttctcccggtacataaccgtcaccgccctcgccgaatgtacggcatcggccatcacttgcaaagaagcggctttgatttaataatgtatatttattcggatgaagtgtaagattgactccgcccgcaacagcaagtgtgctttctcctcttcgtatactttcacaggctaagtgaatggcgttaagagaggatgaacacattgtatccaccgccatactcggccccttaaaattaaagaaatacgatattctgtttgctattgcagaaaatggagacccgacggccagttcatttcctttaagtgattcttcaacgccgaaaaattgatagcttccatatgtgacgcctgcaaatactccgacctttttgcgggtcagatctgaaggtttataacccgcatcctctatggtattgtacactgtctctaaaaagagacgttcctgaggatcaagaaaagcagcttctttcggtgatatccggaaaaataaaggatcaaaccggtctggatttttcagaaaacctccccacttatagcagcttccctcgagcatttccttccggtcatcaggaatttcgcttacgcaatcccgtccattcatcagcacattctggaactctctgatgttttccgcacccggatatctgccgctgacaccgataatggctatatcagcagaaaggggatcggccgcaatgtgctcttttgaaccttctccttcagagcgtgccggcgcttttgtttccactggttttcttttttgctttttttgatatgaaacaagttcagatttgccggccgggttcagcagtttcatcattcgttcgctgtgatgactcaggaaatattcggctaactgcgatatggaatgatattcaaaaaataatgttttcgacaatctgccgatactttgctccagctttttggtcagacgcatgatcatcactgaatcaatgccgtatttctccaggtattgtttttcatctatgagtgaggccggtaatttcaattcctctgacattatattttttagatagctgatgatattttgtcttaattcatcgctttgcaaatcggcatcttcctgccggtctgaatgtaagctgattgtgccggcacgcttcagcacatcctcaatcttttcttttcggcctttcagggcgatcagctgttcagatgattgacacaagctgttctccagagcctctattccgtcaccgtcatctagcgggtcaaggccgagttcctgtttcatgtaggatattccttcatcgtcaatattcatcccgccggaagtccatagcggccaattgactgacaccaccctttcggcagactcttttgcggtcataactgctgcatactgatccaaaaaggcattggcgaaagcatagtcacattggccggctgatccgaagactgccgatgtggatgaaaacaagacaagtaattcaactttcatttttttgatttcttccgccagccagagcgcgccataaactttcgaacttgtgacttgatccatttcttcttttgtctttcttaagataaaagagtcacggagtacgccggcactgtgaaatactccatgcaaggtgccgaactgctcttttgcaaaagcaaacatccgttcagcatcactttgttttgaaacatcagatcggatgtattcaattgttgaacctgagcttcttaaatattcgatcttttttttctgctcttcagttaaatcagagcgccctgtcaatatgagattcgctttccatttttccgacagatgttttgccagtatataaccgagaccgcccaggcctcctgtaatcagataattcccatgatgtttcagcggctgggttaaatcgaatgagccggctttattatagcttttcgtaaaacgtctgccgttttcatagcgcacttcaaaatggatatcccgtttttcgtcacactctctctgatatatatcagctattgctggaagagcggctcccgcaccctctgattgagtgatattgataatctgatagtgaaaattggggtgttcctggtgaacggttttcaccaatccgccgagagcatgatgcagcggcagttgttctttattctgagtttgaaaaatatgcgtcagttttattatctttttccattttaattcaatcagcgcctgtgtaatatacagaagagaaaacaatccgttttccaattgtttctgtatacctcccttactcatgtcagcctgagaatcagaccacaagtgaagaatcttttcgggcggctgataatgatcatgaatgtatcggaacagctttagataatcgtcttttttcacgtggttcatacaaatcgtatcatcatgtaaaacagcaaattcttctccgcggatgacaaacaagagagtgcagtccttaaacaaaccgctcaattcttgtatttgccgttcattttctgcaaaaatcaggagcaatcccgtcaagggtacgctcttcgtactcggaatgaacgattctgtccattccggcttgtaatataaaagaggatggttcgatgcccgtgatttttgattctgaatggatgtcacaagggcatagccttcgtcagccgacatttgtcctgtttgaatcagatcaagaatatcgctgatttgttcacgttttccgttcatcattcttcccccattaattgtttcaatacagccttctgatcaatatcattggtttccaattgacgcaggagacgaatgagttcatcgtccgtctgaacagtgtctttttcatgaccatatctgaatctcacatctctgcactccgccagaatgcttccgtttccatctgtaaatgtcatatgacacgttacatcacggctgttctgccggttcactttttgagtataaacataaaaattttgagcgagaggctgatagacatccgccgctcccattccgatcaattccgggaaggtttctccactgacaaaaaatgcactggcttgaatcgcggactcaagcgcttcaggagaaatcgtaaaattttctctttttgcataaagctcatccggcattgaatgaagcgacagcattccgtaactgtttttcgctgattcaatgacaaaaggcgcttcagccggatgttcagtcatttctgatttgacttcagcaatatcaagcgcttcaggaagcataccgcattcaggcttaacgatatgcgcatttccgctggcaagacgtactttattctcattttttgtgtttgcatatatgtcaaaccgcgcaaagtcacgctcaggcgtcagcgtaatcatcagttcccgtatatctgtcattccgttcatgctttcggtccacaataaatcggtcaatgtttgaactggttgtccaaatgccgccgctgcattgacgatagccatttcagccaaagatgcataagggaaaaaggacacgtttccttcagacagacttagtgcgaacggatgattacggctgatttttttcgtgaaactgaactgattaaaatcggacgtgttactccccaagaaagggtgacccgtcttactcacatccgctgaaacaagtgcttcccctttttccgctatccaataccgctgtttgatcagcggttgtcccggaatagaaatcctgcgggcattccgattcacctcaaaagtctcccaatctatctttcttccatttacccatttggatgctgcttcggcgtaatctgaacaaacgtgaggcatttcattgtgaacttctgattcgaatgtattaccggtatggctcaagctgcttttttcacccctgatataagctgaaagctcttcagcaatgacctgcccggaatctgccactatcgccagccgttcttccatatgatcgcgtcccgtctgaagtgtataggcaatatcctgaagacgcagtttatgattgttatccttcgattcattttctgatagaaaatcagccataacctttgcatattttatcagccgttgtttgtcttgagccgataaaacaaagatcactcggccgctttgatgatcaaaagcttttggcggttcatacgcttccaatataagatgcgcgtttgttcctcctgccccaaaagcgcttaccccggctctcaaaggatggacagcatggctgttttgcggaatattccattcagccgctttccgctgcacttgaaaaggaacctgatcaaaatctataaacggattaacaatatcggaatgcagagaaggaacaagctgcttattcttcatttggagaagcactttcgttaccgcagcgattcctgccgcagattctaaatgtccgatattggatttcaccgaaccgatggcgcaaggatggttcaattgataggaatctttgagtccttgaatttcaatcggatcgcctaatgatgtccctgttccatgcgcttcaatataattgacggtgttcggatcaatgtcagctttacgaagcgcttctgaaatgacctccgcctgcgcatccggattcggtatggaatacccgctcgtctttcctccatggttaacggcgcttcccttaatcacaccgtatatttgatcttgatcttctattgcttttttcaatggttttaacaatacggctccgactccctcaccgggaacgtaaccgcttccgtcttttccaaaactccggcatctgccgtcacttgatagaaactgtcccatgctgaggaacttatatttattcggatgtattgacaaattcactccgccggctaatgccatatcgctctctccgcaatgtatgctttggcatgcgtaatgaatagaggtcaatgatgaagagcacattgtatccagtgccaaactcggaccttttaaatgaaaataataagacacccgattggcaattgaagaatagacggaagctggcgagaaagccgctccgttttcttctccttcaaatagttgatattggccccacattgcaccgacaaatacaccgactttcatcttttccagcatgtttctcgggtaccctgagtcttcaaaacaatttttggccgtttctaaaaagagcctttcctggggatccataagttctgcttcccttggggaaatatgaaagaaaagcggatcaaattgatcggctccgctgagaaaacctccccacttgctgtaagacttccctttcatatctctgtcttcgctgaagaaatcatctatattccagcggtcaggcgggatttctgtaatacaatcttttccgctctttaaattctcccaaaattcaggtaagtcttcagccatcggatactttccgcttaaaccgataatggcaatgtcttgatgccttgtatcagctgtttcatttatttggatctcacggctttcatccaccatgaaggtatcttgaagtgcagattccaatttttctttgtcaccttcaaacacgatcagctgtgatgcgttcagagagagtgaatcttgaaaagctttgatcccattggttttactaaggggaaccataccgattttttgtttcatccatttttcagtttgtttatccactttcatgccgccgtcttcccataggggccagccgatggctactgagacgccggagcgttcttttttccgcctcattccttcacgccactcagcaaaaagatcgatgaaccggttagccaatgcataatccgtctgtccgatattcccgtacatcgagctgcttgatgaaaacatcacaaagaagtccaaaggttcggtttgcagcaagctgtccaataagaccgtcccatttattttcggagcgatcacttcctgaatttcatcttttgatttttgaatcaataaagcgtcgtgcgtcacaccggcactgtgtatcacaccgttgatttctccgaatttctttttaatggtttttatgattcgctctgcatcgcggctatctgaaaaatctcctcttatatattgaacggaagaaccgcctgctttcattcggctgattttgttctttttgtcttccgtcagttcagaacggcccgctaaaataatattggctttcgtttgcgctgcgatatgttctgcaaatataaggcctaagccgccggcccctcctgtaatcatgtatactccgttttctttaaaggagaaatctgagttttgagccggttccgcttcccgtaaggcacggacccagcgcacatttccttcataataaagatcggtttctcccggatgcgcttcagttgattcgcatctgatgatttcagctgtaagagccggcaacgatgtcttgtctgaaactgatatcccgattgtcttaagggccagtttcgggttctcaagcaaaatagactgccctgcgccatggactgaagcgtaaagcggctgatcatttttatggtccgccggataaaggaaaagcgatacaacctttttttccgccttgctgcgcatcaatgcccggctgaaaaagaatagcgggtaagcccctttagaaagctgttcacttattttttccgggccggcaaatgatccttccggccacccgtacaccacggtgtcgggcatttgccccctttttttcagatcagctgcaagcctgtcaaagtgggcttcctccctgtgatctatctcataaattccgtctccgtgataggagaaacgattccctgataaaacgagaatgatctgtgtattttcgaatccattttcagcattttcccgcataaaatgaaaaagctttctgtcatattgaaacagcagacatgttcttttctttttatttccgcaatgcgggtcccacgcggcagccttttgtctccaatacggcgttaaataggtcagagccgtatgattctctccatgatgtagagggaggtctttgtcaacggaagtcttttcgccgctctccgcaaaataatttgcaagtttttgaatcgtcggatactcaaacaataaagtagggtacagttccctgcctgttttctcctccaatgcctttacggcttgcataagtgtgacggaatccaggccttgttcataaaaaccttttaccacagagagtgtttcaggggcagtccctttgatgtctgcgatcagctgctgaatgtctccttctgttataagagcggaaagattttcgttcttactttctttcatgtcaggcttttcagccggttgattttgcgttaagaaataactggacattttttgattttctttaatatacgcggcgagttcccggatcgttttctgctcaaacaggagtgtaggatacagctgttcccctgttttgttttcaagttctttgacaatggcaagcaaagaagcggaatccaggccttgttcataaaaaccaatgtctgtccttatgtcacgcagatctatatttgaaaccccggatattaattctttaaggtgtgtctcaatgctttcgcttcgatctatgattgaatcttttctcatcaggccgtcttttggctgagaagccgcttcagtttctaaacgagtctgcttcagattttcaattaaatcttttgagcgaatatgtttcacagacagccgggtaaaataagcgatcatctccccgtgtgcatcgtacaaaccgtaactgacttggatgacatcccctgaatcatgattttggtcttgcttctctatgtacacataacacctgtcttccaggcgcttcgtcatacggaaagattcaatatgaatgggaatatacgttttcatccggcttgccggagatccttgtgtaaaatattcgggacatgcctgataaaggatcgatatgatggtagacgcatcaagaaaagtgggatgcaattgaaaatagccggtatattgtttggcaatttggctgagcgacaactctgcaagtacagaatgatcagacgcataaaccttccccagactcttcataaattcaaaatgctctatatcaaccttttttaaatagtcataacatatctccatatcggcttcacggacggaggcatgtttgatttcatcgatatgaattgaactcatgctttccgggaatttctgcatgagcctgcagttcatattctcatcccagctttcatccagaatccggtcatcttttacctttctgctcttcgcctggatttcccatccctgttccaatccctgaaaacggatgcggatttctctgtcaaaggtatccgatgttgctacaggttccaaatacaaaatattctgacactcgagttcttcaataggcaaacctttactcagcgccatacggtatatcatatctaaaaatgtgacaccgggtataatccgggtgccatgcacccggtgatccctgacaatatagtccgtatgtttaattgttaatgtgaactgatagttttgattactggccacctgtctcattccttttcttttctttataattctttgaaatcaagtaaaggaatcagcaattctgactcttccttttctggagcttctccattgtcgatccagcattgttccttattgaatataaccggagaaagcgggtgtctttttgtctctccatatcctaatgtgagatggctgtcgctcaatatcatatgtgcgttcgtgcccccgaatccaaaagaactgattccggctctcaaaaccccttttctgggacgccattcttttaaagacgtgttcggaaagaaaggcgactgatcaaatttaaaacgcggatttggcgttttacaatgtagtgtcggcgggagcatctgattttttatggataaggcaacctttataatactcgctatccccgctgcgctcattaaatgtccgaaattcgtttttacgctgcctactccgcaaaattgcgtttcttccgtaacctcccggaacacttcagtcagcgcttttaattcaatcggatctcctatcatcgtaccggtgccatgcgtttcgacataactgagagtatctgcatcaattccgccttttttcagggctttttttatcactgcgctttgcgctttcggattaggtgttgtcatccccattgtctgtccgtcattattaaccgcggaggagtcaattaccgcgtaaattctgtcaccttcggcaagggcgtcatcaagtcttttcaaaaggactgcgccgcatccttctcccggtacaaatccatctgccttctcatcaaatgtatgacattttccttcaggtgaaagcgcccgagcctcactcagcatgacgtaaggcttttgatccagcaaaatgtcaaccccgcccgcaattgccatatctgactcttttgacatcaggctttgacaagcgagatggacgctgaccaatgaagaagaacaagccgtgtctacaaccagattcggtcctttcagattaaaaaagtgtgagatatgcgcgcctatgaaattttgtcctatacccacgatcgtattttttgaaggggaacctattttggacataaacgtcccggtgcgcgaaccgatgaaaacgccgacttctttgtttgatacttcttcctttgtatagccgccgtctctcaatgtctggacgctgacctcaaggcattttttgattaacggatcaagctctgatgcctcacttttgttcatattaaaaaacgcgggatcgaaagactcaatatcttgaagaaatccgccccacttactgatactttttcctttttcataggtgtcagagtagtatgaagaaatatcccatcgcgacgccgggacttcacggacactattttgtcctttcttcaaatttctccagaacgtttctgtgtccggagcatccggaaactcacagcccattccgataatagcgatttggttcagactggttggttgcatttgagatccgctgtcccgtacttcggaagcattttgatttatatgttgctcttttttccgaccctcaatgttttctgaatcaatttgaggactgatcccctcacttgcaaataattcgtttaaatagacgcccagttgtgaaaaactcggatactccagaaaagccgaaggttcaatttttatttgaaatgcatcttccgcttttttgacaagctgaaccagtaagattgaatcaactccgtaatccgcaaaagacgtatcctgatctaaattcccgtaaggtattttcagctccgcggaaaaaatctccattaacttcctgatcatagcttcattgtctccatgaccagagaccactttttcctcagcatccaggttatttttagccgcttgaattcttgtctgaagcagctgctgcagcttgaatttctccggatgtgtctttgccggtataaggcatggatatccgtttatcgtcatgatttcatccagcatggagatacctgtttctgttgagtgtgaaagtaaaccgagtgcctgatatgatggacttgtcacctcgcccatcccaatgtccttccagctcggccagttaattgattgataatatgttctgccggctgcatgctgatacgccgcaaagtaatccataaaagcgttagccgcggcatagtcacttgttccggcgcctaataaaggaaaagcgctcgcaacagatgaaaacaaaatgaagaaatcaagttcgtcatcaataaaaacgtcatgaagtacttgcatcccctgcacctttggctcaaatacttctcttatttcttgatcagatttatgaataaaagccggattcgaatgattggctgcaccagcgcaatgaatcaccccgccgattttgccgaacttcattcgcacctctgaaaagaagcgatgtaatttttctttttccgtgagcggcccggaatacacttccacctgaactcccttttgatccaactcatgcagcagttgtaatttcgaataaagaggtgacttttcatcggtgtcttctaacatgccggctattttagcagattccggaaggtcggttactcccatcagcacaagttttttggctcccttgccggcataatgtctggcaagttctgctccgatccctcttgttccccctgtaataaccaaggtttgatccgtacggcataccggcagaccggataggttccggtttatttccgccgcatgtaatttctcgacgtatggaatataacgttcaccgttccggtagcagatttcactatacagcccgtcagcgcaagcttcatctgtgattacctgtctcagttccgccgcagtcccgacatgcccgtctacatctattgtttttgattttatcttttgatactctgcgctcagcattttatatagtccggctgtttcggctccggctaacgacggcttgtcattcagaaatgtctgcagccctcttgtcacatgtaaaacgaaaagctgtttacgtgtctttatgatttcctgcagcagtatcagcttcccgattgtgccggtgcgtgccccgttttgattactccgcaaatctgacaggtcaatcatgccgatgatttccggattttcttctatgactgctagagccgtttttttggcttccccatccgaatgatcccagttatctgcgcaaatgacagcggattcaatcagaggatctgaatcaaacaattcgaatgcaagccgctcactttcactattagccaggatcatcacctgtcctttcgtaaaagcggaaggcgcagccttttgttttttccacgatttttttaatacatcaaatgataagtcagtcggtgcatggggcagactctgcggtacacctgttttctgtttctgtgctgcttttgcggcaggcacccaatatctgttccgttcaaaagggtatgcaggaagagaaataagcttcggtaattccgcagtgtacatctcttcccattcaacgtctcctccgttcacccagtgaatggccatatctcttgcattttcaaagtgagcggctgacagggcattcttttgaccggcgcctcggcgggcgtttcccctatataaaccgtttaacttatgatctgaccgcaaatacatcgtcagcttattgcgaagatcgtcaatgctgctaacctcaacagcgagccgctcttccatagcgtttctcccggtctgcgaagtgtacgcggcatcagctagtgacgtttttggctccagttcttttatatatgcatcaatcaagagtctgagccgttcttcatttttggcagaaagcagaataatttgcgtcttgttgctctgtaccgtttccatcttttcttcattcttgtactcttcgatgataatgtgggcattagatcctccagcgccgaacgaactgatacccgaccttctggcttgattttgcggcgtctcccaatcggtcaattcagactgcacgtaaaacggtgtttcctcaaaatcaatattaggatttaagttatcggaatgaagggaaggagcaagctgtttatacttcatttgcatcagcacttttgtgatagaagcaattcccgccgcggcctctaggtgtccgatatttgacttaaccgaaccaattgcacaacgataatcgcttttcgagctgtgcaaagctttggttaaacctgaaatttcaatcgggtctcccaaagatgtccctgtgccatgcgcttcaatataacttatgctgtctgcatcaatccccgccttatcaagagtttcactgatgacgtttgcctgctcgcccggatttggcacagtgtatccatttgtttttccgccgtgatttacagatgttcccttaatcacaccgtaaatcctgtccccgtcagcctttgcggcagaaagcgatttcaaaagaacggccccgactccttctcccggcacatatccgtctcctcccgctccaaagcttctgcagcgcccatcgcttgaaacaaaatgattttgtgaaagtaaagtatatttatccgggtgtaaggataaattcactcctccggctatggcgagggtggattctcccctttttaaactttcacatgcaaaatgaacagcagaaagtgaagaagaacacattgtatcaattgcaaggctgggtccgtgcaggtcaaagaaatatgacacccggtttgcgatagacgaataagaagacaagagcgcctgacgtccctcatcatctgaagcaccggctgcaaataactgatagtggctgtaggtgacgccgacaaatacccctgtcttatgccgtttcaactttttctttgtgtaacccgcatcttcaaacgtgtgccatgctgtctctaaaaataaccgttcctgaggatcaattaactcggcatcacgaggcgaaattgagaagaacagcggatcgaatttatcagcgtcttttataaaacctccccatttgctgtcatgacgggcattgtcacctgtgtgataatatttccgaaaatcccagcgctctttcggtatttccgttatacaatcttttccggaagaaatattttcccaaaactgttccacatccttcgccatcgggtagcggccggctataccgataattgcaatatcttcctcggaaggtgcggatggtatacgggaaacggaaagcttctcccgtttcgccggcgccgaatgatcaattcgctgttcggctgccggtaaaaacgccttcttcaactcatgttgatagtgttcaagaaaatactctgacagctcttcaacactgctgtattcaaagaaaagagtcttagacactcttccaaaatacttttcgagacgggagttaagacctaaaattgttagagaatcaattccgtaacggtcaaatgtatcctcgggtaaaatgctgtccgccggtcttcccgtttccgcaccgacgatctctgtcaatagacggatcgtttgctttttcagatctttttcatttaattgcggcagactgttgttttcaggcacagtctctatctttttatggtcagttgagagtaattcacttattctatctttgtctccgctgataacagccagctgagaagcagaacggctcatactgtcctgaaaagcggcaagccctgcttgggcagataaaagttccagccccgtgtgtcttaaagcctgcagctctgccggaccaactgtcatattacccgcaccccataaaggccaattaatagaaagtgttttcccgggacgtcccttaatgcttcgatactgggtgaatccgtccatacatccgttagcgaaggcgtagtcgctctgacccgcattaggcagaacggccgaaagggatgaaaacataacgaagaaatcaagaggctcttcttcagctgctttatccagccaaacggttccgaatactttaggcgctataacttcttctatgctttctttcgctttttttatgataaatgcatccttaacaagtccggcactgtgcaaaattccgtttaattctccgaatgtctgcttaatgtgcttaattaacgcgtccgcctctttttcctttgaaatatctgccgggacatataaggcttcagcaccgagattttcaagcgcgctcaatttttgcgccgtttcacgggatgccggagaacgcccggttaataccagcttgacttccgcctgtttcgccagatattccgcaaacagatacccgaggcctccggctcctcccgtaattaaatacacaccgttcttttttacactgaaactatgtttctccccatcttctttttttactcttttaagctgccttttataataatgcctcggctcataacaggtaaagtggtccgtcttgcattgattgttccattcaaaagagatgacatctgcaatatgctgctttgtaaacggctcgtcaaacattgatttcagctctgcagccttacatgtgaaattcggattttcggcctgtacggtcttaagaaaactttcaaccgcgttataaatgggctgaacctcgccctcggcattttcatacagaaacaaaacttctgctttcggacaaagtttgttcgccatgaaggcctgaaacatttgaaacaaggaaaacagacttttattgagctgctttcttattgcatcttctgtatttttgaagagcccggcagctaaaaaatgaataatatggcggggtcttattttttgagaacgcagaaccccgcatagcgcatcataatcctcatcatttgcaaagttcattttaaaacgaccgttccggcaatcttcgaaacgctcgccggaagtcacgtaaatgaaaggcgcctcatagccttcaagctgtctcttcattacggtatacatgctgtcgtctttgcaaaaaaataaaattggctctttcgtattcgggaatttttcactgcctttaaattcatgtctatcccataccatttcatatagatgggttttccccaaactcttaattaattccagcccttcttcacgcgtcaggctgccttctttcacctttttcacgatttgctcaatttgcatcgttttttcattcatggaaaagcaactcctctatcagctctgacgtctctttcgtattcatctcacctgtttgtgctttttcaagaagcgacatgatttctccatctgctgtatctttatttgaattgtgaagctcagtgttcgagaaagcctcaatcttctgcgcttcatctttatttaaatgaatccaatgtctgttcttactgaaaggataaagaggaagaggccgtttaaccggtttgagttcctcctcatacaagtcttcccagctgatttcacaaccgatcgtccacaactgagccagtttggccggcttgttttgctgaatcagtgattgaacatatgcatgaccttcggggccgccgaataaaggagcgtacagactatcaaaatccgttacatttccttcataaacaccttgcagtctgctcccctgaatgtaaccgtttaatttttcaagaagatctccggtattcgagcaagtgatcgcaaggcggcattcaaatggttcccttccggtttgcagcgtatatgctatttcttcaagaccgattccggacttttctctaaaattgccgttatacggtttatcagctgatcgattccagacgctgctgatatagcggcacagctcactcagggtcattaattcctgaaatatatctagtgatatttctgtgccgtacatttggtttatataagagattaattcggaataagccaacggatcaaatccgaattccgaaagaggtgtctttgcatctatatttgcggtatctaaacgcaggatacccgctgccgcttcccgaaccgcctcttgcacatcacgttcctgcacctcttgctgactgaattgaactgatagttcttcatgtaaaaacgctgttaactctttggctttaaccatcagcctttcctttgttttggccgatagaacaatgatttgatcccgctcggcagttactgctttatcttgtccgtattcaaattcttccacgatgacatgagcatttgccccgccgaatccaaaggaactgactccggcgcggcgcggaatttcatttccttttcgatcttttaatctggcccacttcatagttttattgacaatatgaaacggtgttccgcttaattgaatgtaagggttcagctccttgacatgaagtgtggcaggcagtgttttatacttcatggatagtaatactttaatcagccccggcattccagaggcgggctctaaatgaccgatattcgtttttactgaaccgatgccgcaatattggtcatgattctttcctggatgcggctcaaaagatccaaacgcttttttcaagccttcaatctcaatcggatctcccagttctgtcccggttccgtgtgcttcaatataagatatcgtatcaacaggaatatcggcatttttgtaaacagacgttattagttctgcctgagcttccgggttcggagcggtcaatgaagcagatcttcctccgtgattttctccggttcctctcaggactccgtaaatattgtctctgtcattcattgccgcttgcaatggtttcaataacagaacagctgcaccttcaccgcggacataaccgtcggcaagtttatcaaacgtcttacaccggccgtccctagacaaaataccgagtttatcggtatacatatgagtgactggatctaagagcagcgaaaccccgcctgctaccgccagctcactttcaccattttgaatcgagcgcacagctctgtggattgctacaagactgcttgagcaggctgtatcaatggactcactcggacctctgaaattaaaatagtgggatacacgattgctgatgagcgcctggctgtttccggttcccgcaaacgcatgcgccccgtccgaatgcctcatcagcagctggcggtaatcattaaattgaatgcccgtaaacaccccgatatgtttgccggacagctttgaagctttgtaacccgcatcttctatcgctttccaggtttcctgcaaataaattctgtgctgaggatccatgagttctgcttcccgcggattaatattgaaaaacgcctcatcaaatttatcggcatctgtgataaatccgccccatttcgaatgtacttcgctgctccctttgccttcggcgtattttttccaatcccatcgatccgggggaatttcctgaatcgaatctttttcattgattaaattgatccaaaactcatctgcattttttgctcccggaaaaacacaactcatcccgataatggcaaccggctgcttctccggatgatagtcagcctgtcttgctgtctttttttcaaacggaaaacttcgcggcggcttcacggttttccctgcggttttcccggcgtgcactactttccttttttcagaaatgtttttttctgcatctgtattcccttttgcaacagtacgcagttcactgcttagaaattctgaaagagactttatatggctgtaagtaaagaaaacggcaggtgtcagcttaagcttgtattttttattcagtctgacagctaatgttttcaaactgatagaatcaaagccgagattgccgaaattctctgccgtatccagctgttcaatgttaattttcaataattccgataccatttgcttcagttcttcaaggacattgtctgcagaatccggtcctgtataagaactttcctcttgacgagccggaagcgtatttactttttgatgcggcagatctttttttgctggtgttgttccggcatccccggtaacaaccgaaatttgcggacagtcacttgccaaaatcgcctcaaaagccgctagcccttcttccgtttccaaataatcaaacccggatgcggaaagatatgcttcttcagcttctttgtttaaatgcattccgcctttacgccacaacggccagttaatcgaaatgctcttgccttgtctctcttgccggctgctctgttcggatctccaatttatatattgatcttgaaaataattgcccatcgcatagttaacctgtccaaaatctccgaagaccgaagaaatagaagaaaatacgataaagaaatcaagcggctcatctttcgttaattcatctaagcataccgttccttcaattttagcagtcatgccttccgtaaaatcagtcagattcatctctgtaaataaccgatcatcggcatgaccagctgaatgaataacgccttgaatggatccccaagtccgtttcgtttcttctatgacccatcccatcgtcttttgatctgcggcatcagcttgataatataccgcgtctcctccaagcgcctgcagccggtcaatgttatgtcgtttatcagctgttaacggtgatcttcccgtcaatactaattttgcttgatactgagaggctaaatattttgcaaaaatcaggcccagaccgcccaaaccgcccgttatgaggtaaatccctttctgtttcagctgatgagagtgctctgtatgattgaatacatactcctttaatgtcttaacatacctcttgtcatttatatatttaacttcttccgcctgccgttccacgcctgaaaccatttcgttaagacaaaattcagccattttttcaattgatatacgttctgaaaaaccgattgacttcacattctctgcggatggcaccaacatatttgccgtttttaaacagcctgcaagagcgcccgtatacggatcattcatgccttctttaaaagagtgaacaagaagcagagaatgaagataaagagaggcgtcactgcgggcactcagggcttttaataaataaaaaattgattccaggccgctgagaaggcggtcacccgcgtaaaatgtttctcccgtgtgcaagatgacatcaggagaaaacccctttttctccaattcttcgaataaacgaatataatctgacgtcacttccgggtttatacagaatgtcagcagattttgatcggtctgccgctgatccggcgtgacgagaatgacacggctgtctgattgatttgtcagagcttcagccaatgcttcatcttttgcaaaaaccagaattgtttttggctccctatctttcttttcaatcagagggtttttttgatcccactcatgctcataaaaacgtacattttcattaggcttttcgccaaaaaccagcccgctcagttccatcaaaatcccgccggcattgtctaatacatacacatcataagccgaatcgctttcttcagtttgttctgcatatacataaacgggttcagtctcatgatcaaaaatcgtacattctttaatattttccggggtctctccggcattttcccccgcaaggtatacgacggcttgatatgcgctctcaatcacttccggtttgattatgcaccctttcggcccggcctttgcttttatctttaaaagcacctgtccgttcctgctgacgcagtgctctgcggctttcagactgtcactgcagctgtatccgaattcggcaagccgctgataaaacgcttcgtacggtatacggtctgcgccctgagacaggaacggctcaagatgaatatttccgttctcgtacgccccgccttctaatttgagccgccctgaggaataaatggatgagtcgctctgtttttctatagaatacgatgcaccctgattatccggggttaatacaatccggatctgctcattgcttccgctttgtaacatcggttctctaaaggagagctcagttaatttaataatcggattccctgaagccatcgctccggcagctctcgccatttcaatctggctgagaaacggaaacatttccttgtcttgatactttgtttttatatacaaatcggtatcgcttacattgataagaaacttctgggctttaaaatcagatatattgcatgaaatataaggatgcagatcgttatttacgttcatccgggtgcttcccgtattttgcgcatctattctgcatagctctttggcaaatggatatcccggtgctgatacccgtctcaaagtgacatctttataaagtgacagccaatctactccattaccgccaacccagtattcagcaatcttcacaagatccctgtttgcggctgcttcttcaatttcagctttgttcgtcctttgagcttctgttgtgtctttgccgcttgtaaaaatatgatccctcgcatttccgagagtatagtctgtcagccctttaagcaattcatctcttgtggaggcgataacagccaatctgtgcggcatttcttctctcccggtttgtaaagtaaatgctgtatttctaagtgtttctaatgaataatctctggctgctatttgttcttttgcgcgttttgcatattctgccagcctttcggcattttttgcagaaaaaacaaataaaagctgttcaggttcttcagccgcgagaggagagatagcttcatccgcaaattcttctaaaataacatgggcattagctcctcctgccccgaaagaactgattccggcacgcctgggaacggatgactcccatttttcggctctgtccggtacataaaaaggtgttttttgaaacggtatattttcattcaattcagcagaatgagtcagtgacggaacaatcgttttatgtttcatttgaagaataactttcgtaatgcccgctatgcctgcagcagcctcaagatgtccgatatttgatttaaccgacccgatcgcgcatgtcttcttatcgcgttcggcacctgaaaatgctttggtcaggccggtgatttcaatcggatctcctaacgcggtgcctgttccgtgagcttctatatagctgatgctttttggatcaatacatcctttttttaaggctctcgcaatgacctcactttgagcttttggattcggcacggtatatccattcgtcttagcaccgtggttgatcgctgttgccttaataactgaataaatctgatcaccgtcggcaatagccttttttaccggtttcagcagcacggcacctgtcccttctcccggcacatagccgtctcctcctgaaccgaagcttctgcaccggccatcactggataaaaatcctccttgagtcaggagttcatatttatgaggatgaatggataaattgacgcctcctgcaattgcaatttcacattcattcctgattaaactttcacaggcaaaatgaacagccgttaatgatgaggaacacatcgtgtccaaagcaatacttggcccgctgaaattaaagaagtaggatacccggtttgcgattgatgcaaatgaggaagaaacggccgcttcgtgaccaacgctgtacagctgatattggccgtacataacccctgcaaaaacaccgacgttttttctttcaagcgttttctttgcgtacccggcatcttctatggtgtgccaaaccgtctctaaaaacagtctctcctgtggatcaattaattcagcttcggcaggagaaatattaaagaacaacggatcaaaatgatacacatcgtcaataaatcccccccatttgctttggttttttacttcgtcgcccgccgcaggctgatagtgcagcctcgaatcccaccgatcctcaggtatctcagttatacagtctttaccgttcaataagttttcccacagagtatcaagatcatttgccatcgggtaacgtccgctgataccgataatagcgatatcattgtcatgatacttctcctgctgcacctgatttttcatctggattttctgtttcccgttaacatcggctgtctgtttattatcttttttcttctgagatggggtgccgctcccgttttctcctaaccggagtttatgaagaagagtatccctgtgctcctcaacgaaatactgtgacaattctgccgcagtctgatattcgaataacagcgtttttgagagcgcgccgaaatgtttttcaagctcattcgtcatattgataatcataacggaatcaagtccgtatttttccaatgcctcttctgcatctattttgtccgcaggcatcctgaattctgcagcaattatttttatgataaaatcagatgtttcagctgtcagtttctctgaatcaaatgattcgatatttctccctgttccttcatctgcctgaatattgtcttttcgttcatataattgatgaacatgattgtcaatttgctcatctccgtaaaatacagtgaattgcgaaaaaccggaggacaatgcgacggcaaacgcttttttaccttcttctttttctaaaggataaaaacccgcctttttcattgtctctaccgttcgctcatccacttgcatgccgacttctttccacagcggccagttcagagagagagaaatcgtatcagaatgctggacagaacgcatattcatgaaatgatccatataactgtttccgaacgcgtaatcagattgcccgacatttcccaacactgcggaagtagaggagaagcaaatgaaaaagtcaggattttctttctcaacagcatcattcagccacatcgtaccccatactttcggtctgattacctgatcgaattcctctcgtgacttgttaagaaggaaagaatcccggatgattcccgcgccctgaatgaccccgtttacttttccataagaagttttggcttttttgactacatattcggcttcttccttattggtaatatcagcctgaacataaacagctgaagaaccggcatcctccaatcgcctcagctgttttcttatatgatctgaaagcggagatctacctgttaaaacaaggcagcattttgtttgaaaagccaaatattctgcaaaggtaaatcctaatccgcccgcgccgcccgcgataatatatactccattttctctcagcggcacatctccgcttccggaatttttttcgggttcatacgttttgagctgtttgacataacgctgcatgtctttataacggatctctacatctgaaggctggaaatcactcagctcattgcgtatgatatcagctgcgtgaacggctgctattgactgctccatttcaatgctttttgctgaaattaacggattttccagctgtaatgtccgcaaaaatccgcttgccgccgcgtaaagaggctgttctccggaaaggtgcgaaaaatatccatataacagcttgatcggtttgcggcagttatttttgaagagcgcctgttgtaataaaaacaaagaatagactccgctgtcgcattgttcacgaattgctctctctgttttttcaaacggcatgtctgaccataaatgcaccgcttcccgtatatctgacttctcttcttctataagccatcctaacaggtttatgtaatctttttcagagcgggggtcgatttcaaatacaccgtccccggtttttcgaaactctttccccggcttaaccaaaataacccttgtatcatgcaatgcagcaagttctttactcacatcttcatttttatcaaataataaaaggctgccctcacgccggccgccttttacatgtatgctgagatctgtccgctgccagaccgtctgataatatatcgcctgtccgttaccccctgcggaatgagaaccaagctgctgtatccgctttactccttcttccaaagaaatgttgccgctttctatgtcagaaagtactttttttctaatatgacgggcttctttcataaaaatcttcatcccctttacaaatggcactgccgcaaaatgataaactaatcctgcatatgctccagtgcataatctgcttcttcggcagtcagttcgcccgcttttaattgtctgagaagctcttttactctctcgttctttccattggaatccgctgttgcacgagtctgtgcctccgcggaaaacgtttcttttttacgaatggttacatccttcaaacctgcaagtctttctccttgttcattaagcagctgaatatcgtaaataagctcggattgacctttttggcctgttttacgcgcataagcccagcattctgctgaaacttttttccgaatcgtaatctctcctattgaaaaaggaacataaacagatgcctcttctcttccgtccgtaattccgaacaaagattgcagagccccatcaattaaagacggatgcaatgtataattttcaagagcatatgcggcttcttttggcagcaataagtgtgcaaccgcttctgtttttccgccccataaacgttgaatcggctgaaaagcgcgcccatacaggaacccgttttcccgaaaatacttgtaacattcatcttgttcacggacaaaagcacttctgtttatcatctcttgtctgtcgatattctctatatcatcatcaccgtaatgatgatcataatctaattcccccgtcacaaatccattccttacagcagcatcctcgtcagatgacatattaaataatattttgccgtcttttacggaaatgtgagtgtaaatggtcagactctcttgcaaaagcatggccggtcttgcaaatatcacgttttttaaacgagtgacctctttctttcgatatgaccgcgttcccgctgcgcatgccatttcaagaaaagcagctgccgggagaatgctcttgttttttacgatgtggtcttttaaccaaatctctttttctcttaatgtcgttttaaaaaactgctgttccagagtagattcattcgaatccagaagcgggtgcagtgaagactgctgcggcaatatttccggaaatattgcgctttgatttcgaggcacccagtaagactcctcagcaaatggatataaaggaagcttgaccttttgcggggtatactcttcatataactctctccattgaatatcagccccgaaagaccataattttgctagaagattcaagtcctttgtctccatcatcgcttcgaggaatttatctttcatcttttgatcatgaaagataaagactttatcaaaatcttttgtaacattgcctttgtatacgccctctccaattgttccttcagtacagaaagttctcagcttctccttaagttccggcaaatcggaagctacaacagcaagtctgtcttccataggctccctgcatgtctgcaatgtaaaagcgatatcagctgccgaggctgttgtctcccgctctgtgaattgcagaaggcgccgggcgtattctttcagtctgtcttcatttttggcagaaagaactgcggcaaacggaccgcttattgtttgtgtgtccgcatggttttgatattcctccacaatgacatgggcatttgctcctcccgctccgaacgaactgattgctgctctcctgttagaggcgcctgattctttccgccactcttcttctttctgctgaacgtaaaaaggcgtcttttcaaatcgaatattttggttcagctgttccgagtgaatggatggcgccaacttctgatgcttaaattgtaaaagaacttttgtaagggctgctatacctgcggcagactccaaatgtccgatattagacttcactgaacctatggcacaaaattgtttatcatccgtaaatttctcaaaagcttttgtcaatcctgcgatctcaatcggatctccgagcgaggtacccgttccgtgtgcttccaagtagctgacggatcgcggactgatgcccgatttcttgaaattttcagcaatcagctcagcttgtgcattcggattcggaaccgtaaatccattggtttttccgccatgatttacagatgttcctttaatcactccgtatatatgatcctgatcagcaattgctttttccagaggtttcaacagaacggctcccgaaccttctcccgggacatagccgtctccgccctctccgaaacttctgcacaatccttcggtggaaacaaaattaccttgactcagccaaaggtatttgctggggtgtattgatacattaacgccgcctgcaagcgcaatttcactttcccctcttttaatgctctcacatgccaagtgaatggccgtcagcgatgatgaacacatcgtatccagtgcaatgctcgggccggagagattaaaaaagtacgaaaccctgttggcaatagatgaaaagaaggaactgagcgcaatcggattgccccgcgcagtttcttctgcgccgaataattgatattgtccgtacatggctccgacaaatacaccggctttcataccgttaagcttctcttttgtatatcctgaatcttcaaacgtatgccaggaggtttcgagaaaaattcgctcctgagggtccatcagctcagcttctttatgagaaatatggaaaaacagcggatcgaattgatcaacaccgctgataaaaccgccccacttactgttgattttccccttctccattctgtcgggactgtaattcgatctgaaatcccaacgttcctcggggatttcaataatacagtttttccctccggcaatgttttcccagaactcctcaagagtatcggaattcggatatcttccgctcacaccgataatggcaatatcctcccccggctgaaccatgctcggtgcaggtgtatccttctgctgccggtgctgttttttactcggattttctcttttcttctgtactcttgttaccggagctgcccctgcggccttaagcactttttctttaaaagatgttagaaagaagtttgaaagctcttcaatgttctgatattcaaaaaagattgttttcggaagatccccgaaagtatcttcaagctttgcaataagtgacatgatcataagtgagttgattccgaacttctcaaaagagtctttcgcatttattttatgagcttggattttcaagacaccgctgatgatcttgattaaatagtcattgactttttctttcgcagcatattccgcttcttcatcgtgttccgccgtgagtgtatcttgatctgctgcagctgtatttctttgaatcgaaagcgcctttatcattttatcccgctcaccttctgcaggcattaagctggtaaatgcagaccgcagcattttcagaaacgcttccagaacagaggaagttcgcatcggagtcattccgtatttttcttttatttgaacgattccactgctgtcgagactcattccgccatctttcaataacggccaattgattgatagtgtttttccgtttcgagagagctgggatcgaagcattgcaaaactgtccataaaatgatttgcgtacgcatagtcactttggccggcatttccgtaagcggaaaaagaagaaaagagaacaaaaaaatcaagatcttcgtcttttgtcagctcatccagccagattgtcccgtaaactttcggtttcagtacgtccgtaaaatcactgagacttttatttacaagaaatgaatcacgaaggatgccggcagcatggatgatcccgtttatgctgccgtaccgctctttaacgccgaaaatgaatcgctctgcctctgttcgatctgttatgtccgtccgctgatattcaacaatagagccgctctcattaagcttactgatccgttctttttgatcagctgttaaaaaagaacggcctgtaagtataatcacggcttggttttcattagcgatgtgttccgcaaacagcagcccgagttttccggctcctccggtaatgatatatatgccgcctttttgatacgttacagatccgttatcgtgttccggaatatcaataggctgcagtcctttcacataacgggtatatgagtctattaaaacctcacattcatccgtttgaatgcgctgcatttcactgattgcagcatcccacatctcggaaaccggaggatttatgtcagaatcctcgtggcgtatctgtatggttttcgctttaagcttggagctttccatgtttaccgttttcacgaaccctccgacagcttcatgaaacggctgattcagaccgcttgtccaataaatatgcaataacgtaacaggttcgtttcttcgcattaaagcttttgataataaaaagagcgagtttatccctctgcgaagagtttcattaacagattcttcagtgaattctctgatttctctattccataaataaagcacgacatcaggtgtaaatccgttttcagccaaatcagacagcagcatttcgacatgatgttcatcagaaggattgattgtgcatctattccgttcaattctgtaatcagaatcgggcgttacaagaatgacacggttatgttctccattcatcatctcggcatgctgaaaaagacggttatcctgatcaaaaatcagcatattccccggtgcctgctgattcggcatatcaatgtgatttgtcctgacccaatcggtcttgaaaaaaatggttggggacggagcttgtgattccggctccgcctttttttccatttgttgttttctgtaagtacgaattagctccagtcctgcatcaggagacatttgctgttcttcaattaaggaaagtatttgtttgatctgcactattttccctccagcagctgataaacttggtcagcagaaagttcaccgtttttcaattgttccaataagaagagaatttcctgatcttcatttttatgacctgcggttaattctcccccggtcacttttctgacagagaagtctttcatgctcacggctacttcgccgctctcgttaataaaatcaatgttatacgtataaaaaccggtttctctcaccgaaacatggcatcgggcagtaagcgccctcttaatgtgaagctctctaagtgaataaggaacaaataagccgtctttctcattttctcttaacaaaaatgcagccgcttgaaaaccgccgtcaattaatgaaggatggagtgtaaaatgtgaaaacccgttcgctaaatgatccggaagctccaattctgccattaactccacatcaccgcgatatacggctttcaacgtttgaaaaccgctctgatatgtcaggcccatacgactgaagcggtgataacactctttccggcttatgaccgttttactgctgcgtatgaactgatcaatatcgacatactcaggattgctgtttatgtctccgaatactgtttcacattgtgtgcagatttgctgcacgccatccaggccctctttacatatcgttacgttcaacttatcttgtttcatttccaagccggtataaatgtgcagcgtttttcctttatataatataggtctgttccacatcacgtcttttattttatatactttactttctccgcttatttccgcacaaactagagccatttcaagcgaagcggctcccggcaacacacagtctcctgaaacaaggtgatcagtgacgaaaaattcagttccggaaataacagttttaaatgcttgtttctttaatgttgagacattctcgctgattaatgggtgaagacttttgctattaacctcgcttttgttctttttcggagtaaaccaataactctcttttgcaaacggataagacggcagcggcactctattcaatttctcattgccgatggtcttccattcaaactcggctccattggcccaccattgtgcgagcagctcctcttttccgctttgaagagcctcctgaatcatatattcagaaacagctgcgcgctcttcagtgttttcgcttataaatacgccattttgcaccttgcttttatcaagaaagctgacgtatttatctctcagctcagtcagactcactgcacatacggcaattctctcgttcattgcttcccggccgttttgcaatgtaaattccatgtcactggcattaacggtcatgtcaccggcaatcacgcgatccaagtactgaaccataagccggatatactcaagtaattgatctttggttttcgcagataaaacaaaaatgtgtgttttaccgttgttttccggtacttctttttgaggttccctatattcctctaaaacaatatgcgcgttcacaccgccgaatccgaatgagctgacacctgctctcctcggcagatcgttgttctcttcatcttttatcggattccacttttgagcggtttctgtgatataaaatggcgtattttccagtttgatgtatggattgagttctgaaaaatgggcgagtcccggaagtttgcgatatttaaaagccagtaacactttcagcactccggctattccggcagcggtttcgagatggccgatgtttgttttcacagacccgattccgcagcttttctgtttctcaaaaggaatgtcccattcttgatataacgttttaaatgcctttatgatgctgtttacttcaatcggatcgccaagacttgtccctgtgccatgcgcttctatatatcccgcagtggcgggactgacccccgccttccgccaagcttcggttaataagtccgcctgtgcgttcggattcggagctgtcaaagaattggcgcggccgccgtgatttacagctgaccctttaatcaaaccataaatatgatcaccgtctgcctgtgctttgctgagcggcttaagcagtactgcagccgccccttcactccttacatagccgtcagcgcttttatcaaacgttttgcactttccgtctttggaaagcatacctgctttatcaaaagctataaacagagtagggcttgtcataatatgcactccgcctgcaatcgccatttcaaaatcgcctctttgaatcccctcagccgcacgatggagtgcaactaatgaacttgaacaggcagtgtcaatcggttcgctcggacccgtcaggttcagctggtaagaaatacgattagccaatatacaatgatttaaaccggttgcggtctgcgcctgaacagagacgccattttcattgagacgttccgcatagtccgttgtggcgacccctgcaaacaccgcggttttcgtccctgccagatctgacggcttatagcccgcatcttctattgttttccatacagtctccataaaaattctttgctggggatccattaattctgcttcggcgggagaaatcccgaaaaacaacggatcaaaactgtccgcgcctttgataaatccgcctttttttatttttgttctattgacgtccctgatcggatcgccgtcaaactctttccagtcccaacgatcttcaggaatgtctgtaatcatatcccgccctttttcaattccttcccaaaagtcttccagcgtatctgtttgggggaaacggccgcttattcccactattgcaaccggctcattcatatgtctttcctcttgcctggttttgttttcaggctcaggggaatgttcataggattccggcggaggcgtgctgtacaatgttttttcgtctgctgcagaaaaaggttctgtctcagcaaaaaggatttctccgtattgctcgattacataatcagtcagttcagccagtgaattgcattcaaagaaaatggacggcaataattccgtaccatattgttgattgatttcatttccgagtctggtaaacgtaatagaatcaaatccgtactcgccgaatgaagtttcttcttctatttcctttctgtcaatctttaaaatacttgacatcatctttgcgatgccctcaatcagattttctcttctgtctttcgccgcagattcatctgaagaaaaagacccgcagagatgaagctcttcggaatactcactctttaaaaactcaagaagttcattaaaatcagtaagaccgaaaaaatctgacggcatcattgatattcctaatgtttcgtttaattcgttgcccagcattgtaaacataattgaatcaaatccgtattcacttatcggcagttcaaaatcaaattcccgttcttcaatttttaatacgccggtgatgatgcgcgtcaaagtgctttttaaagattcagttattgacagctctttcggttcgtgattttcgtcggcgattgccgggtcactttttccgctgtcaatcgttatcattcgttccagctttaattcattaccgctaaataccattatttgatgttcacaccctgtcattgcttgatcaaatgctgcaaggccttcccgtttttccagaggcagcattccgaaacggtcataaaggaacttctctgaatgaatgtcaatttgcataccgccttctttccataaaggccaattaatcgagactgtttttccaggtttattttccgccgctctcatttccgcaaaataatccataaaccggtttgcataagcataatcagtttgtccggcattcccgattattgcgctgatagatgaaaacataacaaaaaagtccagaggttctctgtctgtataccggtcaagccatatcgttccgtaaaccttgctggccaggactgaatcgagatcctcttcacgcttattgatgagtaatgaatcttttatcacaccggcgctgtgaataattcctttaacaggacctaatttgtttttgacgagttttatcaggttgttgacattttccttatcagaaatatcggttcttacataaaaaacttctgatccgtttttttcgagctcttttacattgcttacggcttcctcagaaagctctgacctgccgataagcacaagctttattctcccttttcgcacaagatgtctggcaaaaatcaggcccaggccgcctgttcctcctgtaataaggtaaactcccccttcttttacttccatctttttggggggctctgccctttcaatttctgcagagtgtttcacctgcctgattccatctctgtatctgatctctgaagcatcatcgctgatgactgtttctttcacaaggttttttaattcaggcagaccggtgttcagctgtaactgaatttcatcgctgtgtatttcaatatttttaccggacaacattggatgttctaaatgaagcgacctaaaaaagccgctgattgccatttgataaggtaagatttgattgttccttgtgaaaaatacatgtgatatcagaattttatgtcttgggattgttgctaacagagctttcgttacattgaaaaccggcaaaacagcctcttccagcttttcatgaatgttatgctcaattcccgtttcagggctcatcccgattaaaatgacgcggtcaattgtcacttgtctttctttaagaattgccagcaatttctcatagccttcaagtttgacgctgttcaattcaaaggaatcagcttctttttcttgaaaacttccgccatggcggacaaagatcatgttcaggccgatatctttatatgcctggcggatcagcggttctgatatatcctgacggagtgaaattacaaggcagctgtttaagccgctgccttcaggctgatgaagcataggggcccgcttccacatatcagcgtaatacttagctgaatgccgctcattttgagtctgcggtgcagcccttaatgccttcaacgctaagttttttattttaagacttacagatccgtgttcatccataaatagtatatgaaaccttttgacatcatcatgttgtctttcatcggcagcagtaatgtaagcatagccgtttgccgaaggtgggtgaagaatctccagctcacctaattcaaaaggcaaatatgcggtatgatcgtcttcctgagcggacgtaaacccgattgtggattgaaaaatgccatccaataaacacggttccagcagcgcgccggattttttatcaatgctctcaggaagtgatattcgtgcaagaacagcattttcatggataaacagctgttttattacctgaaagccggctccatagtccaaaccgctctgccggaagtttctataacactcagcgccgctgattaatcttttctgtccggttaaccagctgtccaatttaaaatgctctgtatgagaggcgtctttatctccgcatgtcataatgtttccttggcaatgaactgccgcttcagattgcatatcggtttttaccacaaatctgccgtctttttgattcggcagcagatctatcattatcgtcttttctttttcaacggttatcggaaccgcccatacaacctgactcagttttatgactgattttccgtacagcctctctcccgcttctctggccgcttcgatgattgccgctccgggcagaaccatattcccatgcacaacatggtcttttaaataatattcagaatctgaaagcgttttataaaatcggcactcacctgcagaaaaatcaaataaaggagctgtaccggctgctgatgttgtttgcgccttatttgacacccacagtctgttttttaagaaagggtaagtcggcagcgcaatttttgccggttttctgccggtgcggaaatcttcccagcttaaactccctcccgatacccagaattcagccatgtcggctaatgtggttctgccggatttgagcggaagatccgattgccgctgtccgcgtttatgattcggttttttccctctgaatatttcgtgatcgtcaattccattataaaagtgatttaatttcaacatcaggtcatcgatatttttcgaaatgacagcaagcctttccggcatggcttcccgcccttcaagaagggtatatgcaatatcagaaaggtgaagcggcttatttgttcccgccggctgtaaacactcgccctgcttatgacgagccttttgaagatattcctccagctgttttgctgattcccgtaaactcagtgaatgcttggctgagagtacgataagttcttcactttcctcacgccccgtttgacagtcagcagcagactcatactcttccacaaggatatgagcatttgccccgcccgctccgaaagaacttaatcccgcacgccgcggatatttgctgtcagaatgtttttcattcgcgggttttatccagtcggcggtttcctgctggagacaaaaaggtgtctcttccagataaagatccggatgcacccgttcagcatgcagtgttgcggctatttttttatacttcatttgtaaaataatctttgtcaggccggcaattcccgcggccgcttcgagatgaccgatgttagatttaatcgatccgagagagcaatatgaaacatcttcggtataagctctgaacgccttggtcagacctcggacttcaatcgggtcacccagcggcgttcccgtgccgtgtgcttcaataaagctgacacttctggcgctccaaccggccgctttaagagctccttgaattaaatccgcctgtgcggcaggattaggcaccgtatagccattcgtctttccgccatggttaattgccgttccttttatgacggcgtacacagtatcattatcacgtatggcatctttaagcggtttaagaataacggccccgacaccttctccgggcacgaaaccgtcgccgccttctccaaaacttctgcattttcccgattttgaaagcattcccatctgacaccggtataaatagtcagaaggatgaagatacaaatttactcctcccgcaaccgcaaccgagcactcacctttttttaaactttggcaagccatgtgaattgccgttaaggatgaagagcaagccgtatctacagggatactgggacccgtaaaatcaaatgtgtaagacactctgttcgcgagagaccacgggaacgaatttggaagtacatcgtttttgtccgtcggtattctttcgccgagcagcttgtaagaattggttgtaactcccgcaaatacaccgacatgtttttcggtctgctttctcaacccttcaatggtatatcccgaatcttcaaatgctttccatacggtttcgagaaatattcgttcctgaggatccatcgcttctgcttctctcggcgatatttggaaaaacaaagaatcaaatgattcagcattctttaaaaatccgccccatttgcaataaattttcccctcatgcgctttagcgggatctggatcatagtaggtctcataattccatcgttctttcggaatttctgtgattgaggttctctcttttgatagaagatcccacaattcttcgatattttcagccccgggataacggccgctgataccgattaccgctatcccgtcaagatgttctttttcctccgccgcagatgcagtggtgttttgttccggcctggcgggggtaatgctctgaatctgttttcctttttcctcccgtgaaaataaacgtcccagccgatccgggtattcctttacaagatgatctgctaaatctctgattgtatgaaattcaaataaaagcgttttcgaaattgctcccagtgactgctccagctttgtgttgcattgatgaatcataacggaatccattccatattcagccagatgcacatcttgatcgatctcttcccgttctgcaccgacctcacaggagatgatattggttaaaaacaaaactgtctgatccaaaatatcgccttgagccaaaggaacggcactgcctgtctctgtttcgtccgtcaaaaatctctgctgcataaaatgttcaaagcgttcatgatcaccgcagactgcaatattatgcagctgacccgaagttacaatccgcgaaaaccattgcgttccgtcttcagcaggaagttcttcgagccctgaaccatgaaaaagagacgtccgcccttgacctgacaggttcgcccccattccgatgtcttgccataaaggccaattgattgtcagggtgcggccgctgcgcagagaattttgccgtttctgttcccgatattcggcaaaatgatctaaaaagccgtttgcatatgcataatcacactgaccttcgttgcctgcaatagagacgactgaagaaaaaacggcgaaaaaatctaattcgagcgacttcgttgcatgatcaagattcaatgcgccatgaactttcggagcaatcacctctgaaagttcatgctttgtttttcgaaaaagcagcgagtctctgataactcctgcacaatgaatgacgccatgaagacctgcatgctgatcggtaataccgtcaatcattttttttaccgcttctttatcggatatattcgcctgtatataataaaccttggctttaaagctgttcaggtattctaaatgtttctgcttatctccgtttaaaacagatcgccccgataggataatagtggatctttcagttttcgcgcaatattcagcgattttactgccaatccccccaaatccccctgtaattaaatatactttatctttttcagggtattgaatggtctttctgtttgtttctctctgcttctctaacatccgtgcatatcttacgcagcctctgtaagtgatatgaatatgccgatcaggcgctgtgtttatttctttataaagaatgtcagccttctctgaacatgaaacggatgcagaatcatgttcaaagcaaaccgtcttacaatgcagctgcgggtactcttgttttaccgattttaaaaaaccgttcacaccttcaaaatacggcaatttttctttttgatctgcgctgaatgtataaatgaacgttactttgtttataaggttctcgctgattaaagccttagtcagataaaacacagaataaattcctgatgcgagtgtttcttccagttcaggctgtttttcagaccaagtatgcaaaattgcatcgggcgctgcgcctttttcctttaacagacgaatgacaccttgataatcttcgggacactgcctgttgatggtgaaaacactgtcgcttatctgctctaaacggtcaccgggcataataagatatgcggacgtattctctctttttttcaactcttcaaaatagtctttattcccggagaacaacaaaatagtacaggcttgtccgctgcccgcttcattctcaagtgcggtttctttccataccggcgtataaagtgcctgattcttcttttctgaaaaagccgcgtctgattttaccggctgagggtttaaagaaaattgagagcgctcaaacggataaggcggaagcggggcttttcttttatgataatcacctagtttcgcccattcaatctcttctcctgaaagccacatttgcataaatgaatgataaagagcctcatcggctggtttgtccgcttcaaaagcagccgctttgtttagttttgctgatggagggagcgatccgaattgaaaaactgaaaaatcagagatattcacatccggctccgttcccttttcttccgtgtgaagcggcatatggtcagctatctcctgaaacacggcatccatctgattgtattctgtcatcagcggaaaacgggccttattataaaaacctgacggatgctcattcatacaagcaacagcctgtttaattccgtcttgctttttcaataacatgctcagaaaaagttctttagacaagattccttcatccagtaaatttaatatttccagaacataatcattatcaaagaatccatcataatctgttaaatcccatctcttatacagtcttctcatagaggcaaggatagccatgatcgccgcttcctcatcagccggcaatgcgtttcttttatccgccgtgcgattcacaatataagataaaatctcgatttcctgagtctttcccgctttatcccactcttctaaaaaccctttaaacgtatattggtgctcaagaagcagccgtgttttcccgtacaggcggtctgtaaaatcagccgggaagctcagaccgttcagcagcatccttacatattcttcatttaatcgaaccggcgggtacgtttttgcagtgtacggattgacaaatggaatggtcggcggctcacaggataagtgcgaaggtttttcagcgcctgtgatgacagaaatggccttttcaattttgatgatatccgctgctgcaagagcgacgtaatatccgtctccggcgcctgtaatgagacttggcttaaaaccggatgccaggatactttttatgatttccgtattgataactaaagaatacaagcggattttctcaggcgtccattttcttttaaatgaactgtgcaatgttggtatacccttcagcaccgaccttacgttcttttctagatcagggaacacgcgtttcaaaacggcaaattgtttataactttcccatttgaagtcaccgatggcaagcgcccattcagaatcttgtttcctccgaaaacttaatccctctttaagctgatttttaaattcctccttgctgcctgccaataaacccgccctgtaatcaaacgatgtccttgttaaaagggtgctgctgatcgcttcatttgatattttgcaaaattcctcagaatcgtcagaaaaggttctccaattatgtatcatttgtttcatgctttcttcacttttagcggaaaaaaggaagggaacccttccctttctgtcagtttcgtcatttgtatgtataaattcttcgatgatgacgtgagagttaacacctccaaaaccgaaggagctgattcccgccctgagcgcccccccgtctgccgccttccaatcacttgaatcaagcgccggcctaaacggtgttttttcaaactgtataattggatttaccgtatgtacattcaggcttttcggcaccctccgatgtttcatcatcattagaacttttatcaatccggccattcccgccgctgcttctgtatgaccgatatttgttttcacacttccgatcctgcaatattgagtatcctcagtatattgccgatacgcttttgtcaatgcttctatttctatcggatcgcccagagatgtacctgtgccatgtgcttctacataagaaaccgtcgcagcatcaacagcagcgttgtgtaaagcttctgagatgacccggcactgcgcttctgctctgggagcggttatggaacgggatttaccgccatgattaacagccgtcccttttatgatcccgtatatatggtgaccggcttttactgcatcaccaaggcgctgcagcaatacaacgcctgccccttctccgggaacgtacccgttcgccgctgcgtcaaaggttttacatttgccgtcaggactcagcattctggctttagaaaaagaaatatattttccgggttggaaattcaagtttactcccgatgcaattgcataatcgctttcttttgtccgcaatgacttaaccgcttcatgtaaagcaacaagcgacgatgcacaagcggcatttacagacatgctttttccggtcaaaccgaatgtgtatgaaagccggttggagagcatagcttcgaaacttcctaaacaggcgtaactgtcgatttccgattcatgacctgtctgccggtagtcagaattcataatacccgcaaaaacagaagtggttttacgctggagatcccgcaaagagaccccggaatcttcgatgcaccgccaagtttcttctaaaaggattctttgctcaggatccatgtttttcgcttcccggggagagatattaaaaaacttatggtcgaaatgatcagctttatgaataaaacctccccacttgctgattgttttgttcggtatactgatatcagctgagtaataaagatcgtgatcccaccgttcaatcggcacttcccggatggaatctttgccgctatttatgttttcccagaattcatgataatgatctgcatcggggaatctgcaagcaaccccgattatcgcgatatccgcactctgtttattcaaatgaaccattggcctccacccgccccttctttagtgtagaaataacgtatccaatctgcgccttagcagactttcggtctcattcatcattttttcaccaatgtcatcgacatgtctgtttctccatgattccaactccgtgccctttacccaatggttaaaagcgcctaaagacgggccgcaatgaacttggaaattcaccttttgttcttcctgcccttccaaagcaagcagacatcctctctgcaaataccacttaaatagtaacagcatcttatatttttgattgcgctcagctttttgggccaggttcggctgtttatctattatgctttcgtagatttcatcaaaagtcttgttaaaatagtcattttcgagctgaatctttgtcttttcatctatctcactcaaagactcatattgttggtagatttgaaataatttatttgccctgaccggaaacagcgtgccctttttcagcacctgcacctttgttccgaactcaaacagagtctccgaaggcgcataagcagtatcgcatattcctgtctcactcagcatttctttaacaaaaccgcttgtttctgcttcaactgtacattgattaatggatcccgtcataataaaatcagcgcccattaaaaaagcagacgccgcagactcgggagtcccgattcctcccgcggccccgactctgatcttccttgcgtatttgtgtgtttccatcatttcatcccgcaggttaacaaaaaacggcagcatcgccgtcaatgagccctgttcggtattactgccgcaatctgcttcaataatgatatcgtctgctgccggaacacggctgagccactccgcctgctcttccgtcagcataccctgctgacacattctctttacgatactttgaggaggcggactcagaaatgcggccgcaacttccggccgtgaaactttggcaatgatccgattatgaggtatgaccctgccgcttttgtccatcttcaactgatgcgctttgtaataaattaatggcgcgctgacggaaagatacgaagacgcttctattacccgtacgtcatgcttgatatataaatctatcaattccttttctctatcttgatgatccggctcaaatcgcagattcattccgtagggctggccacttttgagtgtcttcttaatagtaataagggcctgttcaatttcccttatagttaaacccgctgtgccaaagaatcccagcattcctttcttcccgaggcggatcagcatttcagcggaagagatccctctatgcatcgcacctgccaaatacgcgtatgtcaaaccgtaatcttctttgaaagattgatcacccaatcgggacaccggtgaagccgcactgctttctatattttcggccaagaggcccttctctttcccgctttccgaattgtccttgttcccttcagaaaacaagagactgtcttttggcgcactaatattaagcggttcctcatctctttgtatggtttgaattaatttagtcagaatgtttccgggaccgatctcttcaaacacagtgacgccttgtcccattaagtacctgatgctttcagtccatttcaccgagtttgttatttgttcaattaaattccgtttgatatcttcttgtttataaggtcttgccgtatagttagagatgaccgggaaattcaattcagaaaaatgaaactcctcgataaattccgcaaattcacgctgtgcactttccataaaacgagaatgaaaagctccgccgacttgcaatacgatataagctttcgccccttctttttcaaaaaaagaggctgcacgttttatctcttctgcagcccccgctatcacaatttgtgaagatgtattgtaattggcgatatctatttggccgaattcatacttttgaagtattttttttatgtgatgctcatccagcccgatcacggcagccattccgccctcggaagcctcactcattaactcgcctcttttagcaaccagccggagacctgtttcaaaattaaaaacaccggccgcaaaaagcgcagtatattcacccagactatgtcctgcaacagcatcagggcgagtatgaccttcttttaaaccctttaaatattgcagtgcgctcactgtataaattgcaggttgtgtatacttcgtatcagtgagcctctctttttcatctgaaaggcataaatcctttatggagtatcctaaaatatgatctgcctttttaatgagctcactgaattcatcgaataagtctctgcccattcctttaaactgcgctccctgtccgggaaagacgtaagcaagcatttgttttcctccttgttccgtatttctgccgtttcttttcgttccgattgtgatttgtttaacatttttcacttcaatttttaaaattgtcatttactctaagcacccggcaccattacttaataagcattacgaagcaaaataaaaaaacctttatgccggataaaggtttaaaagcaaaaagcatgtacaaagatcatattgccgcaaatctaaatagatagaattttctgataattaaaaccgcattttcattctgttttttatatattaatataataaaaacatcccaacgtgccgaaacaacgattggttttatgtgaatatttccctaaataaatactataccatgatttacatgttgtcaatgggaaacacacgtatataccaattcttcagccgccatttacaggcggctgaactcggttgttatcagttcatcagcccatgccgatatgccttcactatactattcgcggaataatagttctttctctttgttgtagtctttagtaaattgattgaactcatctgcttgtttatgcactttttcgtaaactgagtttactttgccgatttgctcttccagctgcgataatgtgagctttttatctttaatcaatttataaaggtccttatcaagtgaaatggctttttcgtactttttgtacaaaagatcataagatgcataccttttttccattaaagcgacagcatgcccggctttttcttttactttcttatcctttatttcttgagaagttttttttgcggattcaaatgctttttttgaatcatcaatactgtctttttctgctttcagatgtttttttcgctgatttgcattgctcagagcctgatcagacagtgtgacgattttcttgtaatcatccatattcagtttaaccgcgctgtcgtaaagcttatgctcttttttctccaatttttccaatgttttctgctctttttgaaacggtttttccgcttgaacggctttttccatcgagtcatgaagcgattcaaccggatcttttcccccgcagcccgcaagcagcatacttgcggcgccgagcgctccgattcctgctaatacctttttttgaatcatattcacttaaaatcccccaatcttgacaatttccactatagaagcccgaacgctttttgacaatagctgagctgtaattggcatgaccgggtaaaaagatgcttacggtgctgtcaaagaatacttgcgtaaaaaattgagaaaacagggcggatgaccatacatctttttggcttttacatagtttatagtagacgccggccctgctgacaaagggtcagcgtaattaaaagaggaggtttttttatgtacggatatggatttggcggcggatttggcggcggttgctgcggcggatacggttatggcggttacggttatggctgcggcggcggatatggccgcacattcgcattaatcgtcgtattgtttatcttattaatcatcgtcggtgccgcttatttaggctgcggctgctgaccttatacaccatgaaaatcggccggcctgctatggccggccaattgtttcgttgcgccgcgataaagaaattcgctataatttacatattaagctttaggagtgaagtttcttgattactatggaaaatattgtacgcgacggacatcccgcgctcagagagatcgctgaagaggttcagcttcccgcttccgacgaagaaaaacagcatcttgctgatatgattgagtttgtgaaaaacagccaaaatcctgaattagccgagaaatacaagcttcgtccgggcgtcggtcttgccgctccgcaaacagacgtaaaaaaacggatgatcgccgtccatgcagaagatgcgaaaggcactttatacagctatgctctttttaaccctaaaatcgtcagccactcagtggaaaaaagctacttgacgagcggagaaggctgcctgtcggtagacgaacccattcccggctatgtgccgcgctacgcccgcatccgcgtaaaggcggtgacgcttgaaggagaacagattgacatccgcctcaaaggttttccggccatcgtgtttcagcacgaaatcgatcatctgaacggcgtgatgttttacgaccatatcgataaagaaaatccgttcaaagaacctgaaaacgccattgccattgaccgttaagaaaaccggcacttcccaaagtgccggttttctttatttcaaaaggcccagttctttgacggcccagctgattccctcttcatccaccggctttgtgacgaaatcggcggcagcttttaattccggaaccgcatttcccatcgccaccccggtgccggcaaaacggatcatctcaaggtcatttagtccgtcgccgaatgcataagtgtcacttacgccgtacggaagccgctcaagcactcttttaatgccttccgcttttgaaccgcctttcggaagcacatccgttgacaattcatgccagcggacgtaatcaaactccggaaaagcggcatatgctttttcttcatgtccgcggcagaataaaagcagctgataaatttcttttcctttataaaatgtttcatcaacttcgggataaggcgctttcagactgccgataccttccgagacgtgcggatgtccggggacggtcgttttcatcgtgtcttccgccataaatacgacggggtgctccccttctgccgcctgctttaataaacgcgcaaccgcatcttcaggaagcggatttttataaatgacctcaccttcaaatacgacatactggccgttgtatgaaataaatgattcaatctcaagctcttccagaatcggttttaccataaacggggaccttccgctggcgataaaaacgtgatgtccagcctctttaagcgccgtcacggcgtttcttgcgctatcgggaatatgtttatcatggtcatagatcgtgccgtcaatatcaaaaaagatcagttttggtttcatgtcaatttctcctttttcccgtttatcagtcgtgtctttttcaatatcatcatacagaaagtttttcttccggaaaaccgccttgatgaaattccagttttacccatgaaaacaaattcattttttccgcatactactgctataaagggctttaaaggaggtatacgatgctgcgccgattacggaagaaactcagaagacagtggggcggaatgctccggaaaaaagtcatcgcatagaagggatctttcggtttttgaaagtcccttttttgctcgagactttccttataatccgttttcgaatataatagaataagcgagtctaacatacggcatttaaggagagatttggatgatttataaggtattttatcaagagaaggctgacgaagtacctgttcgggaaaaaacagattcactttacattgagggcgtttcagaacgggacgtcagaacgaaactgaaagatcagaaatacaacattgaatttgttcagcctgtggacggtgcttttttagaatatgagaagcagagcgaaaattttaaagtattggagttatgagcggaatgaaatttgtaaaaaatgaccagactgccgttttcgccctcggcggattgggcgagatcgggaaaaatacgtacggggtgcagtttcaggatgaaattgtactgattgatgcgggaatcaagttcccggaagatgaacttctcggcattgattacgtaatccccgattacacgtatttagtaaaaaatgaagataaaattaaaggtctgtttatcacccacggtcatgaagaccatatcggcggtattccgtacctgctcagacaagtaaatattcccgtttacggcggtaaactcgcgatcggcttacttcggaataaacttgaagagcacgggctgttaagacagaccaaattaaacatcatcggtgaagacgacatcgtgaagttccgcaagacgtctgtatccttcttcagaacgacacacagcattccggattcatacggaatcgtcgtcaaaacaccgccgggcaatatcgtacataccggggactttaagttcgatttcacaccggtaggcgaaccggccaacttgacaaagatggctgaaatcgggaaagaaggcgttttgtgcctgctttctgacagtacaaacagtgaggtgcctgatttcaccatgtcagaacgccgcgtaggtgaaagcattcacgatattttccgaaaagtggacggcagaattatatttgcgacattcgcttcgaatatacaccgtcttcagcaggtgattgaagcagccgttttaaacggcagaaaagttgccgtattcggacgcagtatggaatcagctattgaaatcggacaaaatctcggttacattacctgtcctaaaaatacgtttattgagcataacgaaatcaatcgtatgcctgccaataaggtaacgattttatgtacggggagccaaggtgaaccgatggcggcgttatcacgcatcgctaacgggacgcaccggcagatttccattaatcccggagatacggtcgtcttttcttcctctccgatacccggaaacacaatcagcgtaagccgcaccatcaaccagctgtaccgtgcgggcgcagaagtcattcacggttcattgaatgacattcatacatccggacacggcggacaggaagagcagaaattaatgctccgcctgatcaaaccgaagttctttatgccgattcacggtgagtacagaatgcagaaaatgcacgtcaaactcgcgactgattgcggcatacctgaagaaaactgctttatcatggataatggcgaagtgctggccctcaaaggcgaagaagccgctgtggcaggcaaaattccgtcaggctccgtttacattgacggaagcggaatcggtgatatcggcaatatcgtgctccgcgaccgccgcattctttcagaagaaggccttgttatcgttgttgtcagcatcaatatggacgactttaaggtttcggcgggacctgatttaatctcaagaggttttgtatatatgagagaatccggtgatttgatcaatgacgcgcagcagctcatttcgaaccatctggagaaagtaatggatcggaaaacaacgcagtggtccgaaattaaaaatgaaattaccgatacgcttgctccgttcctatacgaaaaaacaaaacgccgcccgatgatccttccgatcattatggaggtctaaaaaaaactgcactcattacgagtgcagtttttttattgcagcggaatatgctgaaaggctttgacatcaaacagaccggccgccgtcattttaatatccggaatcaccggaagggctaaaaacgataaggtgagaaacggattgaaatcaccggtgaatccaagcagaggaagcttttcatgaagcacgcccaagctgtcattaacccattccgccgacttatcagacaaaagcccggcgatcggaagcggaacggagtgaagcaattctccgtttttcacggctgttaatccgcccccggtgtcacggagcctgttgattgcttttgccaaatcagcatcgtttgtaccgacggcgatgatattatgggaatcgtgagaaatggttgtggcgatggcgccttcttttaacccgaatccttgtacaatcccgagtcctatcattttttcaccgctgtgccgctctgcgacggcgatttttaataaatcattatctgtatcaggacgaaacgcgtcagcagacggtgcaggcacttctttttttctcgtctccaaatgattcggtatcatttcgattacattcattttcctgccctcttgaatcggtatatgaaaatccgattcagtcagcggcgctttcagccgcactgtatccaacagtgcctggtccggcgaataggaaccggcagactgttcataaaccgtccgtccgttctcggcaacggtccggccggcgaccatggtcttcgtgacggcagcctcccgtacatctgaaatgaacagcagatctgcgtcaaaacccggcgctaccgccccttttgtttcaaggccgtagcactcagccgcatttaagctggcgagctgatacgcaaggaatggatcaagtcccgcctttatcgccattttgacttggtggttcacacttccttctgaaagcagatcatctacatgcttatcatccgtacaaaagaaaaagcggcgcgcgtttttttcattcaccgccggcagcacattgagcgtattttttgccaccgatccttcgcgcagcatgacgtacattccccgtctgattctgtccagcgcttcttcttttgtcgtcacttcatgatcatttgacaccattgcggttctatatatattgatgatatctgaagacagtccggctaaatgcccgtcgatccgctttccgtgacgcttggcatcaagcagtttctgaagcatatcctcttcaccttccgcaacagacacataatccattacttccgcaagcccgagcacctctttctcctgataaaaaggctttaaatcctcggcttttaatacagctcctgagcgttcaaagctagcggcgggaacacaggaaggaagcatgaaacggatgttcagcggcgcctttttcgcctgctctatcataaatgaaatgccttttgctccggaaacattcgcaatttcgtgaggatcagtaatgacagtagtcactccgtgagggaggacggctttagcaaattcaatcggagtaaccatagaggactcgatatgaacatgtccgtcaataaagcccggaacgatcatttggccttctgcatcaatgacttcttccccttcatattcccccagcccgacgatcactccgcccgtaatggcgatatctgcagaaatccattcctggttaaatacatccatgatttttccgtttttaatgacggtatcggctttttgtctgccggctgatgcattcagccgttcagccagtgtttctttgttcaaaatgcggcctcctctttttctttatatggtacaatatgctatcggatcgcctgatcatagtcaataaaaattgcagaatataccgcttacatgataaatgtctttctattctgacataataaaagaccgtccttttacggacggcttttcactttgtatgaagcactcttttttcaaatcgggaaatgtccgtaagagagccgataacgatgagaatatcttctttttggatcatttcagtcgccagcggagatacgatcacttctttttctctcttgatggccacgatattaatgccgtacttcgcccggatgtccagatcaagcagtgtgttgcccgcaagcctgctgttggccacgatctccacaatgctgtgttcgtcggacagctccaaataatcaagcacattatttgatacgatgttgtgggcgatgcgttttgccatgtcacgttcagggtggacgatgtgatcggccccgattttcgcaagtactttctcatgataatcgttctgcgctttaaccgtgatcgtgttcacgccgagttcctttaagatcagcgtcgttaaaatgctcgcctgtatattttcgccgattgccacaatgacgtggtcaaagttgcgcagccccaagtttttcagcaccgattcatcggttgaatcgccgatgaccgcgtgtgatgcgattttggcgtattcatttactttatcttcatcaatatccatcgccatgacctcaaggccttcttcacttaatgctttgcaaatacttccgccgaagcgtccgagaccgataacggcaaactcttttctcataacagtactcctttaaacaatatctctaataggaatagtatcacattttcggcaatgagttcatatagcgtttaagcttttctgaaaaggcgggtgataaatacaggtccgctccgcgttcgatttcttcctgatagtgacccggaggcgcaatttcctcagctttatcaagaaccagaaacgtcaggacgcctctgtatacacggccgccggcacacacttctatgaacgcgggacggtatgtgtgattatcaacaccttctcttttgtacagataggttgccgcttcaaacgggagcttgtacagcacgccttcagttcgtcccccgtcttcaacaagatcggctctggaaccgtcaggacgccttaacgtgaatctcgtcgaatacccttcaacaaccgcccctccgaccggctcggcaaagaagtggtcgacccccgcctgtttaaaccgggcattgtccatacaggagccgtaagcgaaataataaaccggactgtcatcctcccgtttcataaaacggtattctttccagtctccgcttttgatacggctgaatgaggcacactggccgggctttacgacatatgcgaaggcggttttattcccggcatccgtcgtcacggcaacctctttccggtcaaaatcagcataatacatatccagcttacggatcatctgatgatctgtttcatacaattccccgtacacaaaagctgtttctgctaaagacgccgcaggctgacctttatccgtttcgtacagcacaccgtttatcgcggcctgctcgcacacacacggagcgcctttcagcagttcatggttttcttcacgcttccgtaacaaaccgtatacaaaaagaagcaagttatttttcctccttttggacagcagccgcttctaaaggcagaatcacctgaaacgtactgccttctccatttttgctcttaatgttaagtttaccattatgctccttcagaattcgtaaacaaatcggaagcccgagacccgttccctgatcttttgttgagaaaaacggtttcccgatattttcaagcttttctttcgacatgccgtttccttcatcctgtatgctgatcaccgcgtattcttcatcccgttctgtataaatatgaatattcccgccgtcaggcatcgcttcaatcgcatttttaataatattgataaatacctgtttcagctggttttcgtcaccgttgaccatacaggactcagtctgcctgaaatccttctcaatcacagtgttcgacagcaccgcgttcgtgtcaagaagcgtcgccacctgccttaaaatatggttgagatgatgagcggtaaacatcacggtctgcggcttggcgagcagaagcagctcccccagcacgagatcaatccttttaatctccgaaaaaataatatcgaaataatccgttctttccggatactgggctttcatcagctggagaaagccgctgactgacgttaaaggatttcttacttcatgggcgattcctgccgcaagctccccggcaatggccagcttttgagattgcatggcaaggcgttcgttcgtttccagaagctcgtcgaccgcttttttccgttcactgatatcagacatcgtccccaggcttccgacaaatttctgtctgcggtcataatacagcttataatggacttctccccaaaagatcgtgccgtctcttttaatatatttggccgtaaacattcctgacggggactgctgcttgatttgggagataatataatcaatgatatgtttttcttttataaaataatcattatacatcgtgcccatacattcgctgatggagtggcccgtaatcgtcgtccaggcctgattcaaatatgtaatattcccttgtgaatccgtctgaaaaacgatttcctgcagattgtccatgatccggtttttctcatctgaaagcgcctttgctttctgctcgctgtccttcagctccgccagcagctgctttttattgtccacataataagccagcagccagacgctgattaatgtgacggcggtaaaggtgatgtcaacgggccagttaatcggattccgttcaatcatataaaataaataatcccaaaacataataaaaatcattgccaagattaaggaaatgatacgcgcttgatattttcccatagtcccacctgccgctaacatttctacatatattgtaacattgttgactgcattattgactaaaaaatgataactattcccaattaattgagcaggttcgcttacttttcccgtgagtttttgcacaagttcataataaaaggacggaatgatgccccgccctttttgctgattatgatctatcttttaacgcttcttcgatttcctcaagcagcattttcgctccttcaggacttaaaataattttgccgttgccgtactcctgattttcggaggtaatttccccggtcatcaagcaaatgccgtgcggcttgtatttttttaagacaattttgtctccgtcaacgaaaaattcaatactatctttaatagcgatatccaatgctcttcgcaattcaatcggcatgacaatacgcccgagttcgtctacttttcttactacaccaattgatttcatagaaatcccctacttcctttaatgtctcttctttatgtccaaggaaaatccttcataaacgtagacgaaaggaacggagcaaaagtttctcagcatccggaaatgaatgttttttacaaaagaaagccttttgaaatacgggatacagactttccctccttttttacaaaaacatttcattcccggcggaaacccccaaaaatcgtggtttttctcagaaactttaaatgtagaatcaattaaatcaggatagggattgggtgaaaacatgtttcaatcaactgagatcggaatcgacttaggaaccgctaatatacttgtttacagtaaaaataaaggaattattttaaatgagccttccgttgtcgctgtagatacaacaacgaaagcggtgcttgccatcggaacggatgccaaaagcatgatcggaaagacgccggggaaaatcgtcgccgtacggccgatgaaagacggtgtcattgctgattatgatatgacaactgacttattaaaacacattatgaaaaaagccggaaaaaaaatcggaatgaccttccgcaaaccgaatgtcgtcgtctgcacgccttcaggctcaacggccgttgaacgccgcgccatcagtgacgctgtcaaaaactgcggagcgaaaaacgttcacttgattgaagaacccgtagccgctgcaatcggggccgacctccctgttgacgagccggtcgcaaacgtcgtcgtagatatcggcggcggtacgactgaagtcgccatcatctcattcgggggcgtcgtatcctgccactcgatcagaatcggcggcgaccagcttgatgaagatatcgcctcgttcgtcagaaaaaaatacaacctgctgatcggggaacgcacggcagaacaagtgaaaatggaaatcggatttgcattgatcgaacatgtgccggaaacgatggaaatccgcgggcgtgacctcgtaaccggtctgccgaagacaatcagactgcagtctaatgaaattcagcacgcgatgcgtgagtcgctcctgcatattcttgaagcgatcagagcgacgcttgaagattgtccgccggagctcagcggtgatatcgttgaccgcggcgtcgtgttaaccggcggaggctcccttttaaacgggatgaaagaatggctgacagatgaaatcgtcgttcccgttcatttggcggcaaatccgcttgaatcagtggctatcggcactggacgttcattagacgtcatcgacaagctgcaaaaagcgattaaataataagattgtgcttcttttttctccggccggctcatattgtgagaactggagaaacattaaggaggaagcatatgcttagagatgtgggaagacgcgtagcagtagccgtcattttaagcggaattattttggggggtatgagcatttcactggccaatatgccccattctccggccggcggcgccgtaaaactgaatcatccgtaaagacgcagcaaaagctgtgtctttttcgtttgtgctccttcctttcctttatgaggcgatatttgatatgatgagaaaaaccgatgaggaggaatgaacgatgagttcgtttactgaaaagttaaatacatatgctcagctggcggtagaagtcggcgtcaatgtccaaaaaggacagcatgtcgtaatcaatgcctcaactgatgtccgggaacttgtcagactgcttgccaaacattcttatgaaaaaggcgcaaaaaacgtcaccgtaaattggcaggacgatgaactgtccagattaaaatacgagatggcaccttttgaagcgtttgaagagtatcctgaatgggaagcaaaaggaaaagaagagctcgcgaaaaaaggggctgcgtttatttctgtcgtctcatccgaccccgacctgttaaaaggcgctgacggcaaacggattgcagcgttccaaaaagccgccggaaaagcattgcatacatacagacaatatattcaatcagataaggtcagctggacggtgatcggagcggcttcaacaggctgggcgaaaaaagtgttcccggatcagccggaagaaacagccgttcagcttttatgggaagaaattttcaaaacaacccgcgtaaatgaagaaaaccctgtggcagcatggaaaaaacacgatcaaaatcttcatgaaaaagtggaacacctgaacaaaaaacattacagcgccctgcattatcaggctgaaggaacagacttaaccattgaactgccgaaaaaacatgtatgggcaggcgcgggaagcgtgaatgaaagcgggcacgaattcatggccaacatgccgacagaagaggttttcacccttccgcagcgtgacggggtgaacggcacggtttccagcacgaaaccgcttagctacggcggcaacattattgataacttcactcttacctttgaaaacgggcgcattgtcgatgtgaaagctgaaaaaggcgaggagattttaaaaggcatcgtcgaaaccgatgaaggctcacactatctcggtgaagtggccttagtgccgtacgattcaccgatttcacaatcaaatattttattttacaacacactgtacgatgaaaacgcctctaaccacttggcgatcggcagtgcgtatgcctttaatattgagggcggcaaacaaatgacacgggaagagcttgtcaaagagggcttaaatgagagcattacacacgtagattttatggtcggttccaaagacatgaatatcgacggcattaccgcggacggcaaaagagaaccgatcttcagaaacggaaactgggcattttaataaaaaaaggaggcgatcaggcctcctttttatttcgcttcatacatttgcaagttggcgcagacggtttccaaaacaggtgtatcaattgacaagcctttcgctttctcaagcaaaaagccgtgtaaatgatcaccttccgtcacctttcccttttccatatctctcagcatcgacgatttcatatggtaagacatgcttgtcaatgtgcgataactctcttcttccagaccaggatctttcgggatgccggcagccttgaaaatggctccgatttcagcaaagaggcgctttgccgtgctgcgaccgccttctgtttctaaaatcggtccgaccggctgttgaaacagagtggtcactcccgcctgcgcggcaataaacatatattttttccaaatgtccttttcaatatccccgctgatgatgacatccgctttcacgcctgcaaatgcgttttccagctcattcatacgttctgtgcgctccccgttccattcaccgaaaacaaaacggtgggcagcgctcgtatgaagaatttcccctttgtcgttaagagcgctctcaataaagcagaggccgcccagcacctgccgttttgaaaaagcttcaaacagctggttatagtgcctgtatccgtttaaaaaaggaataatgaccgacgaaggtttgacaaacggtttgacatcccgaatgacgtcctgcaaagaatacgcttttgaagcgatgataacggcgtcaaatgctccttcttcgcccgccaacattaatttcggcttgattgaaacatcaccttttgcacttttgacggtcaaacccgtttcttgtaattgttccgcccgtttcttgcggacgagaaatgtaacgtcatttcccttttctgcaagacgcgcaccgatatatccgcccactcccccagctccgacaactaaaaacttcatgatgcattcctccgtctcttttcaatttatgtattcctttattgtaatgggaagtcagaagattgaaaacttttttcaaataaaaaagcagagtctcccctgcttctttattacgcgtatagctcttcaagctttttctgcacatccgcgttttcaagaaattcgtcataagacatttgtttgtcaacaatgcctttaggcgttaattcaatgatgcggttggcaattgtctgtacaaactgatggtcatgagatgaaaacagcatagcgcctttaaagctgattaagccgttgttaagcgccgtaatggattccaaatctaagtggtttgtcggttcatccagaattaagatattcgcgccggaaagcatcgcttttgaaagcatgcagcgtactttttctcctccggaaaggacgtttgattttttgttgacttcttctcctgagaacagcatgcgtcctaagaaaccgcgcagaaagctttcgctttggtcatgcggcgagtattggcggagccagtcgacaaggttcgcatcgctgccgtcaaaatattcgctgttgtctttagggaagtacgcctgagaagtggtcacgccccatttaaatgtgccgctgtctgcttccatttccccggaaatgattttaaacaatgtggttacggcaagttcgttgcggcccgtaaatgcgattttgtcttctctgttcataataaagctgacgttatcaagcaccttaaccccgtcaatcgtttttgttaaaccttcaacccgcagcacgtcatttccgatctcgcgttccggcgtgaaattgacataaggataacggcgtgatgacggtttgatatcatcaagcgtgattttatcaaggagtttctttcttgatgtcgcctgctttgatttagaggcgttggcgctgaatctggccacgaactcctgaagctgtttaatctgctcttcttttttcttgttggcttcctgagaaagctttaaagcaagctggcttgattcataccagaaatcatagttgccgacgtacacttgaattttattaaaatcaagatcggcgatgtgcgtgcacactttatttaaaaagtgacggtcatgggatacgacgatgactgtgttctcaaagttgattaaaaactcttccagccactgaatcgctttcagatccaagtggttggtcggttcatcaagcagcagaacgtccggcttgccgaacagcgcctgtgccaaaagcactttcaccttttctgaaccgcctaagtcggccattttcttcgtatgcaggtcttcagagatgcccagcccctttaacaaaatagcggcttcactttcagcttcccatccgtttaattccgcaaactctccttcaagctcagcggcgcggatgccgtcttcatctgaaaaatcaggcttcatataaatcgcgtctttttcctgcatgacttcgtataaacgtttatgtcccataatgacgactttcagcacttcgcagtcttcatattcaaagtggttctgcttcagaatggcaagacgttcgcccggactcatatggacatcgccggtctgaggctccagctcaccggataaaattttcaaaaatgttgattttccggcaccgtttgcgcctattaatccgtagcagttgcccggcgtaaatttaatattgacatcttcaaataacttgcgatccgcaaaacgcaagctcacattatttacagcaatcatttagaatcctccatcgtgtctatcatcattaaaagtataccatgaataaaggggaagagaaatgtttccctgcgaatatacaggtttgaaaagatgcaggcgtcaaacccggagcgctgtgatacaatagatatatatacatattcatcacggaggaacaagttgaagcttttaacactcacagaatactgtcttatgattttcttcaccggggtttttctggccgtcacaggctttacggcacgtgacatcggcttgtacgtcggaatcgccctcatttatacgttttcgcatctcttttccaaacggatgcttgaaagacgcggcaaagagaagaagcaggtgaatctttttttcagcgttctggccattgtcggatcagtgctggccacggtattgttcatcgccgtcgcggcctcgtttgccaaataaaaacgcctgctgtccgaatcgggcagcgcggcgtttttattttgtctgacgcatatcatgaaacgggaagaacacaaacttcgaggtgccgacgatccggttttcggcaattaagccgaggccgttccggctgtccattgagttcagccgattgtcgcccatgacgaagtatttgcctttcggaacctttacggggccgaaatctcccgtcaggttgactcccagttttttcgcttcttttttattgctcgcgaggtacggttctgcgatttttttgccgtttatataaagcgtgtcatttttcatttccaccgtttctcccggttttccgatgagccgctttacataatggactttcgatgtatcgccgttaataatgacgatgtccccccgctcgatttctccgatataattgacgcttttgttgacaaacagtctttcaccgtcatgtaatgtcgggtacattgatgatccttccactaagtacggttcaaacaggaaatggcggattaacagcgcaagtgcaaccgctataatgatggcctttccccattcccaatatgtgttggattttctttttaccgatttttcagaagtaggtttttgttcttcagtcaacgtggttcctcctagacgatcactgtttcggttcatgtaccatctttactttatcacaactcatcacaaaatacataacgcttctatgcgtatatgattgaaaaaagcgcccgtaaaggacgcttttcgcttatttctctactaccggttttttgatgattcccaagataaccgccgttacaatcgctccgatcacgatgctcattaagtaaagcagcggatggttcgtaatgaatgcaacgaatatccctccgtgcggtgcaggaagcgttacccggaaaaactctgtcagtccgcccgctaccgcagaaccgacaacggctgcagggatgacgcgaagcggatcagccgctgcaaacgggatggcgccttctgtaacgaaagctgctcccatgaagtagcacgtaataccggcttcacggtcacgtttagagaatttgtgtttaaagaatgttgtcgccagtgcgattccaagcggcggagccattccgcccgccatgatggccgcatgcggcgcatagtttccggcatcgatcatcgcgataccgaaagtgaacgccgctttattgagcgggccgcccatgtcgatagccatcataccgcctaaaataatacccattaagacaaggtttccagttccaaggctttcaagccaatttgttaagaaattcataaacgctgctacaggtgtgttaatgacaaactgcatcaggacaccggtgataaaaataccgagcagcggataaatcaatacaggttttaatccgtcaagggtctgaggaataaagacaaacagctttttcaaaaggactacgacataaccggctaagaatcccgcaatcagtccgcccaagaatccggcattcgcctgcgtagccataaatccgccgaccatacccggcgcaaatcccggacggtccgcaatactcattgcgatgaatccggcaagtactgcaacaatcagctttaacgcattaccgtcaccgataaagttcagcgctgcagcaaacgtgttgtatgtcgggtctttcggatcagctgaatgaattccccagaagaatgaaatcgcaacgagaattccgccgccgacgacaaatggcagcatgttgctgacaccgctcattaagtgtttatagaaagtacttccgatgcttgtgcctgatttctgtttcggaccgtcttcatttgaagcggaagatcctccgccgctgccctcgtaaatcggcgcatcttggttaactgctttttcaatcagttcctgtggacgtctgataccggccgtcacaggcacttgaagaacatgtttgcctttaaagcgctccatttcaacctgtttatcagccgccacgataatcgcaggcgcgtcttcaatttcttgagccgtcagcttatgtttaataccgcttgagccgtttgtctcgactttaatgtcaacgccgagctctttcgctttttctttcagtgcgtcagctgccatgaacgtatgagcgatacctgtcgggcatgccgtaaccgcaaggattttcccttttcctgacggcgctgcctgttcttcctgctcttcttcttcctcatcgtcatctttgtcatgctgattgatgatgtcaatgatcgcatcttctgattcagcttcaagaagctgtttgcggatttcctcacgcataagaagcgttgaaagtcttgataatgcctcaaggtgcgtattgttcgctccttcggttgccgcaatcataaagaccaagtgtgccggctgaccgtctaatgattcataatccacaccatcttttgaacggccgaatgcaatggccgggttaatgacgctcgccgtcttcgcgtgaggaatggcaataccttcgccgattcccgtcgagctttggctttcacgatttaaaatggctgctttgtaagcctctctgtcatttaatctgccggctttgtcaagcactgtcaccatttcatcgataacgttttctttctctttgctttctatattgagatgaattgtatctcttgttaacagctcagttatcttcacttttctttcctcctctatagacgtgtgactttaacttcaggaagaagctgctgtacaaactcttcagttccgagttcttcagaaaatgccgtcgcgcttccggaagcaactcctaaacggaacgcatcttccaaaggcagctgttttgaaattcccgcaaggaatcccgcgacgacggaatcacctgcgcctaccgaattgacaagctttcctttaggaacattggcgaggaaaaccgcctctttcgtaaataaaagcgcaccgtcgccagccatcgaaacaatcgcgtgttcagcgccttgttcaattaattttttaccgtaaggaacggcagcttcggctgaatcaatgaccgtattgaacatttccccaagctcatgatgattcggcttcatcaaaaacggtttcatttctgtcgctttcatcagcgcttcaccggagatgtccaccactacccgggcattctgctttctgcatgcctcagcaattttttcatacgtgttatgcggcagggaagaagggatgcttcccgctaaaacgacgatgtctccctcttccagagcggagaactgttctaaaaaggcattgaacacttcgtctgaaatcgtcgggccctgtccgttaatttccgtttcatcgcccgttttcagttttacatttatacgcgtgtcttcatccacctcagaaaaagccgtttccagaccttcctgctgcaaaaatgacgtgatataatttccggtaaatccgccgacaaaccccaatgcttttgacggcacatggtgtcttttcagtaatctcgaaacgttgatgccttttccgccgggatacttcgtgtcatagctggaacggtttaaaccgcctacggcaaaatcttcaacgtgaacgatatagtcaacagacggattgagagttacagtgtaaatcatggtttcactacctttacgacagttttttcttggtaatcatcgaatgcaagttcttcagcttcagtggtaatgatagctgcatcgcccaaggcggcaaacgctgcgaaagaaatctcgccgaatttagaaggatcggctaaaacatacgcatttttcgcctgtctcacagcctttgtcttcagaagagcctcatccggatcgggtgttgtaaagccggcttcaatgtgcacgccgttcaccccgagaaagcttttgtcaaaacggtactggctgaccgccgttaatgaggcgccgccgatcatcgcacctgttctatgcttcacatatcctccgagaagataaaaaggaatccccttccttattaaagcgtcgatatgcataaccccgtttgtgacaaccacaatgtcctttgtatgatctataaaatcaatcatgtgcaatgtagttgttcccgcatcaaggtaaatacagtcaccttcttctaataaagatgccgcttcttcagcgatcttcagtttatcctgaaggtttttggaggatttttcaagcatatcgggttcttgcctgctgttggaaagtttagacgccccgccgtgaacgcgctttaaaaatccgcgctcttcaagtgttgataaatctcttctgatcgttgattcagaagcgtttgtcatgcttatcagctcttgaatcttcaccacatctcgcttttcaatctgatccataatcagctgatacctttcaggagtaagcatattccgcctcctttgaaaacgtattcatttcggctgcaagataattgtaaacgctttttttacttcaagcaactaaaatcactcaaattcattcaataactatcaaaatctttcacatttgttcatattaacgtatgtacatagggtttgtaaactgtaaattcgacaaaaagggggacaattgtatgacattttctttttatcataaatgaaaaaagtctattatattcattcaatcattaaaacacaaaaaaccccatgcagactgcatggggcgccggttattcataccgtaacgcttcaatcggatctaagcgtgatgctttgttggcgggcagcatgccgaagatgacgccaatcagcatactgaacagcacgccgatacaaaccacctgccaggaaacgagcgacggccagcctgcgataagggaaacgagtgttgctcccccgtagccgagaccgattccgattaagccgccgattaaagtaagcacaacagattcaattaagaattgtgtcagaatctgtcctctcgtggcaccgagcgatttgcggatgccgatttctcttgtccgttccgtcactgatacgagcataatattcatgaccccgatcccgccgacaacgagagaaataccggcgatcgaaccgatgatcgtcgtcataacggtcgtgacctgaccgattcccgccgcgatttcttccatattcatgacttgataggcctcttttgtaccgtgattgtcatttaagagacgggccgcttcttttcctgttgttttgatttgatcagcggactccgtctgaacggaaacgttgctgtagtcgttagtaccgaaagacgttttcagcatgttgaacggcacatacatttcactgagtcctaacgataaaaagccgctctcttctttcagtacgccgattacttctacgggctgtccgccggcccagacgattttcccgagcggagacgttttcccgaacagcttttcagccatttttttcgagatgattcccgctcttttcccggaaagaaaatcattgtccgtaaacgtccgtccatcttgaacgtccagcttttttacgtccaagtagccgctgttaatgccgttcagcgtaatatccgtgtcttcttcatggtaacgggccgtcatggattttaccgcggaagcgacaacctgctttacgccgtccactccttttaatccattaatatcttcttctgtaaaactcgcttgctgtaaggcgttcggattggctgttaattcttcatcactgggcatgtaaaacaattcaatcgtattgcccggcccgctgatggattgcttcagcatttgctctccgccctggccgacagccacaacaacgattactgaaccgacgccgataatgattccgagcattgtcagaatcgatctcagcttgtgagctcttacggaactgagggccatccggagattttctgacaggctcattcccccactctcctctgctcagaatcacgggaaacgatcatgccgtcacggacgaaaatcactctgtttgtacagtccgccacttcaggctcatgagtgacaagcaccacggtcacgccctctgcattaagctctgtgaactgctccataatggaaatgcttgttttcgtatccagcgcgccggtcggttcatcagctaaaatgagcttcggttcgttcacgatggctcttgcaatcgcgacacgctgcttctggccgccggacagctcattcggcatgtgacgcatccgatccgccaaaccgactttttccagcgcgtgctcagcccgttcctcacgctcttttttgccgataccggcgtagatcatgggaagttcgacattttttcttgcattcaatcgcggcagcagctgaaactgctgaaagacaaaaccgattgatttgttccggaccgccgcaagctctttttcggtgcatgaagaaacatcttcgcccgcaagactgtaattgccggacgtcggtctgtccagacagccgatgatattcatgatcgtagattttcccgatcccgagggtcccataattgacacatattctccttcttcaatcgtcaggtcgattgaacggagaacatcaaacgtctccttgccgatctgatagctttttttcacctttgaaagctgaatcatctatgctttcacatccgttccgtcagtcaaaccgtcagccggattcagaatgactttatcatcctttgaaagcccctcttttatctccgtaagctgatttgcggtatcgccgactttaactttcacgcgtttggccttcccgtcttttaccgtaaagacccagtgctcatctccgtcttttttgactgcggaggacggaagcgtgtcggctttccgtttgtcggtttcaatgttcataattaatttaaatcccggcttgccttccggaaggtttccgatcagcttaacctgaaacggatactggacggcttgttccgtgctttcccccgaagcagcgcttgacttttgatccggaacgaggccgacagccgccactctccctttccacgttttaccggggatggcgtctgaggtgattgtaacgctttggccctttttcactttcagcgtgtcgtattcggacaaattgccggcaacgaccaggtgttccgggtctcctatatgtataaccggttcttgaatatccgattttttagaagccgcttcttgatttaccgagataaccgtcccgtccatctcactcttaacattgagattcgacacttgattttcaagagactgcttttgcaaatcagattgctttaattcgatttccgccgttttttgctgaagctgcagatcagtccgttcggattcaatttgttttttggcttccgcttctcccacttgttttgccagatcttgttccttgctgtttaatgctctgagtttttcttcaacttgttcgatttgcatccgttttgattgttccgtcaactcattttgttctttatcaaggttgagctgctcatttgtatacgtgactaacgacgaccctttttttactttgtcgccttcttttactttcactttatcaagagttcctttatctgcttcataaaaaacatactgttctttagagaatttaagtgttcccggaaccataaccgtagatgagatttctctgttttccatggttccggtttcgatttttttttcggcgctgccgcccgcgggagcggcagacttataaatattgataccgatgaatactgcaacaattacggcgatgccgattccgatccaaatttttttcatgttatacacctgctgtcactgaacttaacagtcctccgactgccgtaaccaaaagcataataacaaacaggacaaccgcggaagtccaggccgcttttttcgaaatgccgcctgtatagcgaagtcccaaagccagcaaaatatagctccagatgctgaaaatgtcgaacgcgcttaaaaagaccgcgacgccgtctccggccggtatgacactcgccaaagatgtaacggcgtacaatgagcccgcaccggtaaaataagtgacaagaccgttaataactaagccgatattggtaataaacgccgtaaacaggctgagtgagagcatttttttgtaagttgtcacgccgcctgaaattttgacgcacagccagtaaatgagcggaacgataaacagagcgataatgcccccgaagattcctccgaacatcgtgccgaatttagcgaaggttttggtcatttcaatctgatcatccgtcaaaccgtcaagagatgagctgttcagcacttcttcataattcatcccaagcccgcgcaaaatactgccggccgcgatgagaatgatgacaatcaggagaggaatgccgatgaccggcttttcttttaatcttttaaactgcacaacaggacttgtaatgacgccgaaaattgacggcttttccgtgactgccgcattgcttttttccaggtttggttccatattgctgatgcctcctatgtattattctgtttatacgtacgctttaggctgagagaagtttcaatttttttgccgtttgcgtatttatgctaaattgtaacacaaattctcagctttacgttccataattatgtaaaaaaaagcatcatctgaccggtatgacgggtggctcaaaaccttgtaaaggcactgatatcagcctattcatgcagtgaaaaccgcctcaattgcaaaaccctttaaatcccatttaaatattctctgaaattcagcgcctatatacaaaaagagccggatggcaatgatgcacacccggctcttttttcaccctccgcttacaggagggataaaggcaatggtatcaccttctgttacgatgctgttgtcttttacatatgtttcattgattgcgatcatggcattgtcaatcgtctgaaggccgtaccgttcctttaacagcgtttttacagcagacgccgccgtctctttttcgtcaagttcaatgaccgatgttcccgcctgctccgcaagcccggcaaataataatactttaatcatcgcgattcccctttatccaaatccggttttccgttcggatagggcgttgtttccagctgatcgcctatccattcttccccgtcttcccagatttcttttttccatatcggcacaatctgttttatccgttcaattgcatattcattcgcctcatatgccgcctttctgtgcggagaagacacggcgattacgaccgctgcttcaccgatatcaaggacgccgacacggtgagtgattgcagcttcggctccttcccatttcgcgctgatttcactgccgatttgagaaagcatttgaacagccatcggttcatacgcttcatattcgagacgcaccgtccgccgtcctgcagtccactctctgaccgtgccgataaacgttgtgatggcgccggcttcacgcttttcaactttttttacgatattttccgcaatgataggttcccttgtaatttgaaaacgttccatttaagcagattcccctttcagctgcgaaagcacaaacataatggcagccggatcgtccgcatggaatacgggcttgcctgcatctgtcggcatatgctccgtatttctgctgacaatcgcgatcacgcgctccaaatgcttcagcttttgccaatcttcgctgtttttgatcataatgattttcggatgcggcgcatgtttaaatccctctatgagaagaccgtcaattcccagacattcatacagactgatcaaacccgccagatcccatttttttcgcgccgtaagctgcaggacgccgtccccttctactgccgtaaccgcggctccggcttttgaaaagcgctccgagtctttcccgtcagaaaaaggttccggttctccgccatgtccgtgatgttttaaacatccaatatcgcactctttcggcgccgctttcagcacacgttcaataaacgttgttttaccgctgttttgaaaacctacgatctggacgatcgggaaagaattgaccacggccattcacttccattctcatcacgaatgaggagcgcgtgaaccgtccggcccgcttcataccccctcgttcctcccggcagaaggataaacgcgtttgcttcggcaagagatgtgactgagcttgatttgtcgagaccgaccggtgacgccatcatttttccgtccttatgataaacaaatgccctcacaaatctcgtaaacggattcggcttcggaaagtcgtttgttaacacggcttccgcccatccggaatgaggtttttcattcagaagccacgtctgaatcatcggtttgacaaacagggtgaatccgacataacatgcggacggattgcctgaaaggccgaacagcagcatgtcatcggcccggccgacagttgtcacgctccccgggcgcattgccactttgttaaaaagaacttccgctccgagcttattataaatgtccggaagaaaatcaaaatcgccgactgacacgccgccggtcgtgatcagaaaatcaacttttttcatagcttccttcaccgcagcatagctgtcatcaaaatcatcggaaattttccctaagttcagcggtactgcacccgcttcaatgacctgggcatacaccatggcagcgttgctgttgcggattttccccggctcaagcggatcgctgacatgaagaagctcggttcccgttgcgataatgccgacaaccggctttctgaccacgggaacggaagcatagccgaaggttgctaaaagagcggttacgcccggcgtgattttcgtccctttttttaatagcgagctgccttttttcgcatcttctccttgatatgaaatattatcccccgcatgaaaagggcgtttcactgacatgtaatccgtgcctttttcagaaaacgtttttgtcagctcaagcatcactacagcatccgcgcctttgggaatctgcgcccccgtcataatgcggaccgcttcataaggcccgagttctttttctgacacggcgccggctccgatatggtcaatgacttcaaaggtgacggcattgtcacgggaagccgtttttgaatcgctcgccctgatggcaaacccgtcatacggagaacggttaaaagccggcacatcatgatccgccttaacatcctccgccaaatagcggtggagactgtcctcaagcgccacccattcggtatcccccttttttttataccggctcacccggcggactgcttcgtccacctgaatcggcgttcttttttcaagcatagcaatacatccccttcctacagtccgatcactctggccagaactgaattcgcttcttttatatcgtttgtaccgtgaatcagagcccgtccgtcctgaaaaataacgattctgaagcgctcgtacgccatgtgcagcaaaaattcatttgcttccactttaccgatctgcttcagacgtttgacaagctcttctttatccagcctctttaaggcttccgatctgatttgaacggtgtctcttccgcacagcacgcttgctttcggcctgttttcaggctgcagatacggatatacgggctccgcgccgcaggaagggcaatgatcccgtttgatctgatccacatttatgctcatattggtgttattccacacgtcaaacgtgaaaaagcgccgatttaccgccgcatgatttcctgtcagcaatttcagcgcctcagcctgctgataggcggagacgatatgaaccgccggaggtatgatgcctgctgtatcacatgtcgctccgcccacgggcatttgctcaaacaggcaggataaacacggcgtaacccccggaataatcgtcatgcacattccctgactgctgacacaggcaccgtaaatccaaggtgttttcgttttcagcgccagatcattgatgaccattctcgtttcaaaattatctgtcgcatccacaatgcaatccgcttgttcgatcagcggttcgagcgtttccgccgtaccttccgccgcgtaagcatcgatatgtatattactgtttaccgctaaaagacgcgccttggccgccattgctttcggcaggcgctgtctcgcgtcttcttctgtatacagctgctgtctttgtaaattgctccattccacataatcccggtcaataatcgccatacggcccgctccggctcttgcaaggccctctgccgcggctgttccgagggctccggctccgacaatcaggacactgctgtcagccagcgcctgctgccctttttcccctatcggcttaaatcttgtctgccgtgaatagcgctcttccatctgtgttgtccccttgcatttttatttccatcataccatgtttcttaccgatcagtcctgatttgaagactcgacatgcgccaaaagtctggtgtaatcgtcccgtgtgttgacattagcgaactcctccggcccggcgccgatgtcttcagcctgcacataacagacagacagccgtttcagcgtgtctgtcattttcagtttgttttgtgtcagctgatcaaaaagcacatcctgcacccgtttatggtaaaccgccaagaggggctgctctctgttttcacaaatcggtatgacagcgtccagatttcccgtcagcttcatttcaagcgcagccatcgtttttcttgtcacgagcggcgtgtcacaggatatgaccgtatatgtttcgccttccgtttgtttcattgccgtatatatgccggcaagcgggcccattccccgaaaccgcggctcatcggcaaaaacatgccgctccctgtttgataagaacttttttatatgctcagggcggctgataattaccgtttctccgccgccgaaggcttttttcgcctgttcataaaacatgccgcccttccactttgcaaaagctttcggttctccgaatcttcgggaagctccccccgctaatattacattcacccgtttcatgtcatcgctctcccattctatataaaagcatagcaaacgcctcagccgaaatacaatattacggtgcttgtctgtttaattaagaggaatagccgttgttcctttcccatattgtagtgttaacatcatgagggagatggttcttatgaaaatatcaggtccgtttttccacgacacttctcaagagaacctttacttgaaatccgaactttccagatgcagaaaaataatttcggaatttgaagcaagctacttccatcaaaaaaacaataagcttcaggaggaaaacgccaatattaaagagcagcttcacaagctttctgacgaattggaagccatggcgcaaaaacacaaacagactagtgacacggaacgttctttgcatgaaatcagggccgggctgctcgataaaatcgtcattctgcaagaactgcttcagcaggaaacgtttcggcggaaaaatgagatggaagaaaaacatcggctgcatcttacaaatgtaaaatttgaagaagaaaataaaaacttacatacccgcatccgctcacttgagaccgccgttcaaaccgaacggacttctcacgaagatatgaaacagcgttatcatgccgctgcagacgaaaatacccggctccaaacacaaatgatagaaaaagaataccagctcaaacatattaaaatagaaattaatcatatgagagatcgaatactagaaacaaaagaacggcttgtagaaatagaaaaaacgaaagaaaagttatttcaagaaaccattctttcatataaacggcagcttgacgaaagcgatgcttggattgccggccattttgctgatattgacagccgcacggcggaaccggcggaacaaaccatggaaattccttccgtttccaaagagactgttcaggcagaagacttgcttacagccgttaccgaacaagtcatctcccttcaaaaacaatttgtagaatcagagtcccgcgatcagtcgtttgatgaaaaactggatgcgttgaaagaacgagctgacggcgaaaagcctttccaaaaatatgttgtcaagcttgaaaaaaagcctggaaaagatgtgtcacttccgcagaataaacgggaaaacgcaaaaaaactgcttgagtaacgcaagcagtttttactgttttattcagcagccgtatcatttgccgtttctgctgtttcctgagaaatttctccctcaagaatatattggccgcggtatggttttttcacttccggatacattttaattaagctttgcataaatgttgtcatattaggaatttcaaggccgctttccttttcaatttccttttgcagttcggaacttttgatcgctgcattgtggcgtttcaatgttttaatcgctgcttcgcgcagttttgccgcttttgatcccggtctcgccgtccctcttcttcttcttgtagaaccgtctggaatgccggcgggaagagacgtaatagactgcatctgcggctgggaggattgcggctgtgtctgcggcttttgatagcttctcatttcctgtgctgcaagctctgcaagcaccgggagagagtcactttttttctccggacgaaactctttttttgtatcggacaggctgcccgtattgtctaattctctcagttttgcatatattttatcacgttctatttgatattcacgaatgacttttacctctgcttcgttcaattgttctaaacgtaagcgcagcgcttctctttcattaaacatgtgtaaaaccccctgtcaaaaatttaaacgcttttattaagatattagattacaaaagtaattttatcaactattattttatcattttactattttatttactctatgaaaaattgcttattttctgaaaatggtactttatatacaaaaatcccttatcatataggggattctggacaaagttccaatttattgaaccatttcaaaatataacttgaaattacttgtttaatgaaaattagcgtgatatctacaattttcgactataatatgtaaaagttaatgatatggataaaacaagcggtacagcgtgtttacggctgtttctcttattttttaagccatacatgccatattggaattttttatccaatagtcacaaaaaaaccctgttacctaacggcaaagggtttgcagaaccgagacaatagtccggcggagattgtcccgattactcagaagcctgctccgtttctgaaagtacccggctgatgcgtttttcaagcattttcatcccgctctctcccgcttgaaaatggcggagctgtccgcttttatcaaaaacgtaataagccggcacatattcattttcaaatgcgtcagccagcgtatgatcgctgtcaacgtaaatcggctgagagatatcgtgttcagccgctgttttcttgattttctcaagatcaagatcgtcttcggaacggggcatgtggacggccaccacattcagctgatctttatatttatcacgaaacccgttcacctcaggcatcgcttctttacacatgcggcagctggcggaccagaagtgaatcagtgccggctttccgccgaccagctgttccttcgtaacttctctgttaatccatgctttagcgcctgttaattcaggcatttgctgatgtaatttcatcttatttccctccttatgaaaaaagttttttgccggggctttcagtccgccgggcaacgttctcctgttttccctccaaaggaaatgatttggctgaatcaccatgttaaaatgagtgtggcgattccttagttcatatcttcacaaaaatgaagatattgaaaccgggcaatatgaacaaatcataaatgtaataactggtttctatgaaaaggtttatcttatttaaaaaacgggtatatcacttttagctttttcctcaatagacttgaaaggaagacatcactatgattgatttaaaacactttgattgggccgggcttctcacatctgccgggattttcatcataaagctggctctcattattttagcgtattttattttccggacggcaggaaaaaagctgatcaagcatctgtttcagaaattcgagcaacaaaacaacctctccacaggccgcgcttatactttgcgaagcctcgcgcttaatgtgtatggatacatcctgattttcgtttttatcgtaatgattttggatttatttcactacaatccgagcgctctcattgccggcgccggcgtggtcggtctcgccgtcggcttcggggctcaggggcttgtcagtgacatcgtcaccggattttttatccttttggaaaaacaaatcgacgtcggtgattatattacggttgccggctacagcggcattgtcgagcaggtcggtctccgtacgacgcaaatccggagctttgacggcacgcttcactatcttcccaaccggggcatcacgaatgtgagcaaccattcccgcggaacgatgcaggcgcttgtcgatattaaagtgccgcttgaaaaaaatcttgatgaaaccattcaaatcctgcaaaccgcatgtgacaaagcagccgctgagctcccgcagattaaggaagggccggacgtcatcggggttcaggatttaagcacgtcagaaatggtgatcagaatcattgccaaaacagaaaatatggagcaatggcgggttgaacgcgtactgcggagagaaatgaaaatcgcgcttgaccgttttaaaaacgccgcttccgccgaatagaaaaaccgaagcgtaagcttcggttttttctttttaatgaaattttttttccacttcgctgcagatttcgtcggcggtcattccggaagccgtaatgacgggagcctgagttgacgtatcggcaatgccttggacattgctgtcaagtccggttacgacacagcagtcacaattcttcgcatcctcaggagtcttcatcatcactacgtcatatcctttttgttttaacgcctgttctacatccgataaagattgttcaattccaatttttttcgtcatattgaacacctccgttatgtagaatgctcaatttttgttagattattcttcttttcggatttaattggcatacttcgaaaaatatccgaccatgacatttaccgcggtttccatcgcttcttcatccgggttcagcttggcgtgatgaagcccgtgggatgaatcggcccccagccagaacataaagccgggatattttttcagcatatatccgaaatcttctccggtcatcgcttctttcgccgttttcacgtcagcaagctgatgatcgctgacaaattgcataaattcttcggtcaggccgcttgtattataaacttgatgataaacggacggatacgtgacttttcctttgcatcggaagccgatttcaattcctttgacaagctcttcaatccgctttttcaccatacgcattgattcctcggaaagcgtccggatggttccctccagatgagcatgctctgcgatgatattttgcgccgtgcccccggtaatcgttccgacagttatcacagcgctgtcaagcggatccgtatttctggatatgaccgtttgcagctgcgtgacaagcgtgctcgcggcaacgaccatgtcatctgctgtatgcggatatgccgcatgtccgcctttcccctcaaggtcgatgacgagctcgctcgtattggcaaacagcaatccgcttttggtggaaatggtgccgaccggcagctctggtgctatatgtagggcggtgattaaatccggcgtccattttttcagcacatcgctttcaagcatcggtgccgccccgcccggtccttcttcagccggctggaataaaaagagcagatcatgtttgacggggtgatggacaaaatgatcaataatgccgagcgcgatggtcatgtgcatatcgtgtccgcatgcgtgcataaaaccggggtgctcagatgcaaacggaagccccgtctgctcttcaatcgacagagcgtctatatccgctctgtaggcgagcattttttccggagccgtgccgttgattttgacaaagatgccggttctccaagtttcgatttcaattctttcttccggatattggtttaaaagattcagcaggtactgctgggttttatattcctgaaagccgatctccggaatgcggtgcagatctcttcggatggcaatgagccgctctttttccatatgtattcctccttgagataagaataaggcgtggattttatcatccacgcccattctatcaaaccattccttacagctggcgtaattcctgtttgatttctgttttgccttttgttttttcatcgatatctttgatttttttcgctggtgttcccgctacaacggtatatggctcgacgtcatttacaacaatggctccggcggcgacaaccgcgcctttaccgattgttacgccttcaagcacaaccgcatttgcgccgatcacaacgtcgtcttctacgacaacaggcttagcgctaggcggctcaataacgcccgctaatacagaacccgctccgatgtggcagtttttgccgacagtcgcgcgtcctccgagaacaacgttcatatcaatcatcgtaccttcgccgatgactgaaccgatattaatagatgcacccatcatgataacggcattgtcgccgatttcgacttggtcgcggataatagcgcctggctcgattctcgctttcacatcttttaaatcaagcatcgggatcgcagagttgcggcggtcattctcaatgacgtaatcctcaattttgtctttgttttcttcgattgcgcttttaatttcagcccactcgccaaaaacgacgccggattggccgttcaggaatgttttagcggaatcgccaaagctgattccttcgagatcgccttttacatacacttttacaggcgttgattttgtactattttgaataaatgaaataatttcatttgcatccatcattttcatatgtattgtcctcctctgattttctacctcattactgtaacaaaggaaggatacaaagacaagaaaaaaaggaacaagcctttattctgccggctggctgcacagcgcggcaaactgtcttccgaattcccggagctcttcttcctcactgccctcagggttgttttcaattttgaccgacggcagcaccacccgtccgccgcgggccgtaattactttttccaattcgtcaaccgctccgcaaaaaaactcataggacgtatctccggaaccgaacaaagcaaatgtttttcccgtaaactccagtttttccatatcttcagcaatatcgagcatttcatcaggaagatccccgtctccccacgtatatgtgcctaataaaatatactcgtaatcattaaaaagttcggcatgaatatccatcgcttcatatctgtctacggatgcttgtgcttcgatcagccctttttcaattaaatccgccatcgcctcggtgtttcctgacattgtagcgtaaacaagcaatacattccccatcttcgtctctcctttatgcataaaaactaatgtgcgagccgaaccgcctcatacggtctgacaaacttactttcgtaaaggcccgcgcaaaaaaagtcttcttcccggttggccacccgccatccgtgaccgcggatcgtatcaaaccactttaattcaccggcagcgagatcagcttgataaatacgcgaaaatccgctttcgtcctgtgacgaagtgacataaataatcccgttatcctcagacacgtcgagaaatgatttttcccgtacattgtccccggctgtaatggcaaactcctcatgcgtccgcacgttttggacagcaagctccccccgttctccctttgccgcgccctttgctgcaatgagccagtcattctgatacatcatcattgaagccgtcatgcgctgcctttcgcggcttatacgccggatgcggccttccgtcagatcatacgcccaaatgccgccatgattcatatgaatccgggtgccgatataaaccgtctgaccgtgtaaacaaagcgaacggatgacaggcggctcctttaattgtgaaaaaggcttagccacatgccaagtgacgccgaaatcatcagataagtagatgcagtatgtgccgtgcgcacagacaaatccgtcattccgcccggcaacggcccatacggaggcgctggtcggaaatcgggaggccgtccaagtctttccttgatcggccgatctgaggacggcgcctttttctccagccgcgaatatgtagggccctatataagtcagcacatgaatcctgctcttcactcggaatagtcttttccagccttcttccgccgaaaaatgaaaaataccttcgcctttcacagcgacaaaaaatcctgaagatactgatgccatgacagccgtcgcgcctttatgaaacatggcaccggtctccgtggtgagcggcccatgcaagaaaaccgcggacaaattctttgcagcattcttgatcttcagccgtctcgggcgccagctcaattttcagcgtttccggatataaattggctccggcctgttcaaacgcatcgcaaaacagcgtgaccgcttcgcaaaacttcgggtaggcatgatcgcctgaaccgaaacaggccgttttcagtccgttgagctggctgtgcagaatatcttcgtaaaaatcttccgcttcgtaaggaagatcaccatccccccatgtgtatgtgccgacaaaaacataatcatatgctttgagagaatccgcacctgcttcgtccatatcaagacagtcaaccgctatctgatgcccgctcagtgtttcttttataatgccggcaatatcctctgtattccccgacatgcttgcgtatatcattaatgctttctgcatatgatcacctcgtaattgataatgattttcattaacatatataacactttaaatgataatgattttcattgtcaataaaaaataaaaaataaaaaaagacagcatgattgctgtctttctaaaatgggcgttcctgtttcagcatatctttaatgacagaaacaaaagcctgcacctgttttaattcaaatgccggctcataaccgagcagccatgtgtcacggccgatcggatggtcctttgtatcaagcaggggcattttatttactttatcttcctcttctaaggtgactgacggcagaatggcataaccgatcccgtgcagcgccatttgcttgcacgtttcaatctgatcgacaaggatggtctgtttcggcgaggttttgaatttttgatgccaccaatgctgaatttcctgaaaatatgtactgtcacttttgaattgaataaacggccggtcggtatgggcaatatcatcaatacaggaaatttccgtatcgaccaaatataaatgatcggtcattaaataatctttccggcctttccattctggatttccccggataatgccgatatgtacctgatcttcatacagacttttcagcatttcgctgctccagcctgtaatgagagagacctttgcattcggatatcgttccacatatgtttttaacactttcggaagccagtgctgcccgataatggaggcgacggcaagctttaatgtgccgtgaatctcaccctcaagttcatcaatgttttctctgattctttcttgccgatccgtgacgtcatttgcaaattgtatgattttttctcctgccggcgttaccgtaagtcctttttgagacctaagaaagatctttgttccccaggttttttcaatggtctgcaatcgctgggacagagccggctgtgacacgaataaccgttcggcagccttcctcatgtttaattcctcagctaaaactacgagcatatgaagctcttgaagctgcatgtcgtcctccttttcaatgccttttcgtatttcttatctaccattctaatcaaataaaggctgccgaggcaagcgccactcatatgtatgcgttttctttttctggcatgcgaaagaacaaataggctgatcgttcgagcctacttattcaatgatctgatatgactgctcaactgctttaatacgacccttctcgtgaaaatgccttcaaagacgccttcatcattttcaacgcagacaaagccgttgttaatgaccatgctgaaccctttgataatcggatcattgatgtggagacggggaatgtctttcagcatgacttcctcaaccgtaatttgatccagcttctcaaactcgatccgttcaagtccgaaaatgctgttcataatcatatttgtcccgatcaaaccgtgcagacggtacgaagcgtcaaggacgggaatggcggtatagccggttttcgtcagcactaatagagcatgctcaaggttgtttccgacttgaacgtgcgccactttatccgcctcgatcataaattgtccgactgttgcatcaagaagctgatctgattgtaagctaatcatgtcacttcgacccctttacatttttcatcaaagcatgtattccctatattgcaataatataaacattatcattttttgtcgaaaagtttccgtcaataaaaaagatactctttgcaatcgagtatcaatttataggccgctgattaattttcgttccgaaaacggtcatagagcgttacgagttttttataagtggttccatcaacgctttttgaccctgcttctatatcgttgatttcgctggtcaaaagctcaatggcatattcttgattgatcaggatattcagcagaagtttctgttcttcttccgtaaatcgttcactgataagactcatacgtaatcaggccccctatttttaactgaatacctctgaaagcaatgtgaaatttgctttcagctctaccgctagaataagtaaacagaaaaaaatcgtcaaccgcataattcgacattttgcggattctgtatgaaatattattttgtgtaacgattggcataactgaatgctgtgcaggaatcgggcttgattttcgcttcaatgcccatcgaggtaatgcggccggtcatttcttgtatcaattcttttgtcagccctttttgaccgatatccagatgcacttcaaatgaaagatccgccccttcatccgcaaaaggcaagagcaaatctgtcagttccataagacagccgtcgaggatatgcgcagccatctcctggctgaacgcggtttccagcgagattttttcgcgaaggctatgtatcggtcttgcaaggtcgtgatttttcaaacagccccaagctcccttgcctgtacggtgcaagtgtatagccgtaataaactttgtgaagtcgcggtaaacttgtgaatcagtccctacagacagcacgtatgctgaacgggggtctttattgacaaagcgtttcagccgctccgtcacgtcttgaaaggtcatctgtgcctcagaaagattataaaacagaaaagaatcagccatgtacggacactcctctttccagagtctacaaccaaacgaacaagcacgttcctttgcataatttaataaagctccgcttgcggaagaccggaagcttggtcagcctgaaaaatcaaatcacattactgaaggagctcaaaaatttcaatagaaatcatgtcaatgttatcaaacggatatgtgttaggtttttcacctttttggaaaaccgtcagttcaaacgtttgatttttttcgaaatatttaacactgcaaattttttcgccgttaacttcaaaataacgctgcatcggctcgttagccgcttccgctgtttcttgcagactttgcagccgcgtgatgatacccattaattgtgacattctaaaaaaagactcctttcaaaaaacaacttcaaatcaacaagtatttattataatacaagtcctacagagcatcataccataaagtagaccgggatggcattttcccgctggattttcaaaaagaaataaacgggaaaaccgtgttttcgaatagtttgaagcttttttcggaatgtcatacacctttcaaaaataatttttcgctttttgagccgccattgtcagatgtatgtaaggagaagcccttttatgcgcagacagcataaaaaaacttggcgggggtagcgccaagctttttcggatcttgatctgatagaggggttggggaacagagagtaacttctctctataactaaatgataatgattatcactatcattgtcaatcgttttttaaaactttttcacatttataaaaaaagcggcttacagcagccgctttaaagtaacccgtcctgttcatataaataagagtaaggcagatcgataaataaatacatattgtcatccatcggatatgaaaaggttctgatcatctcacccgtctcaatatcactgtacaggtcactgaaaaagccttttcttgaattccgcatcttcataatgttttctaaaaagtacggacgccagctccagtttttctccacgtattcaggctgataaagccattcgccggactgcttgaacacatttcccgtcagctgatagccttcttcatcacacatataaattctgaaacagcagtcggtcaggttttccgccagttttttaataaactcatcgtccgcctgatgggttttcttcagttcggaaactgcctgattgacccgcttataaaaattctcagagtgttcgtatactgtctccagcttctttttttctctcgtgataaattgctgaaactccgttttcaagcgtgcttttaacaggctccggtctataaaatcgccgctcggcgcctgcagataataaccttgaaaaaatcggcctccgtttctccatgcgtactggagctgaaaatcagcttctatatcttcatacagcagcgcggcgccgatttttctcgccagcaatgaaatgctgtacagcacatgctcatacgaaggtgacggctgagatactttcagcgcctgcaaatctattttcagaaggtccggtgaaaggagcgcgattctgtccaggttgctgctctccttacctatattgtccaccgcgattttaatgccgtatgtacgatagtaggcaagcatatggtacagctgttcaatgtcgccttcgaaattgtgctcggtgatctcaagcacaatacggttcaattcaatgccctgctcttcgtattctttcaaaagctcaagaaagctctcgccgtggtcaagcatcaatacattcgcatcctgattgataaaaatcaacagatcgcgatcagcttctttaaaccgctccagcgcctgcctgatgactctgtcatcgacctcaagcttatattcttccggaatgccggaatctaagaaaaacggcccgaggctctcaatctccgcatctgccaaaatacggccaagcacttcgtagcctacgactctttgttcctcagcgttaaaaatcgcttggtaatacggaataacatcatcaatattcgtcagtatatcaagtgggtccaacatgttatcacctgcttctctatctttgtctgattatacacaattatatcagcaccacaaatgtttagattaggggaaaaaggaggcagtatggcagcagtttaaaataaaaggggaaaactttttaagatcactcttcagaccggttaattaaggacgttattcatttgtttcaccatcacaaataaaaggataaatataagagcatgataaccggcggctgtccaaaaataatggctccaatcagtactgttaaatatccaatcatcatcatgtttcaactgaaagaaagttccttttttatctaaagtgccaaatgtaagagttgttaacccgccagcactcttggaaacgtcaactccatacattgaaccggcatgatcagtatgatttattggcatatacgtataatcagataaaattgtttccgccagcttggttggcagagacacatatcatacagccgatgtatcgcctccgagcccactcaaatactccctggctttaataaatttcgtttcatcaggaaaatctatatgatatagcttttcaaatctgattatttcatcagatgtaagattggtattttgataatactccggagtaaaagcgcaaatgataaagtaccaaatattaaagatgataacgcaactgcttacaaatagtacaacgaaccattttaataatttcttcacttattcacctcttaatctttaaaaattatatcataattttgaatagaaaaataaaacaagcgaacggtcacctttaacgttcgcttgttttgcaaatatgtcatgtaaattaaaacgggtaaggattcagccattgccccccgtccattgtgatacaatccccgtttatataggatgcttcatcggatagcaaaaacgctgccaaagcggcgatttcctccggtgtccccagacggccgagcggcacactgttcatagtgcgggacaccgctttttccgattcaaacagcttctccgcaccgcctgtccgttcaatcgggccgggggctatcgcgtttgtgcggatgccgtatttgctcccccattcaacggccagcgttcttgtcagtgacaatacccccgctttggctgcagcggaatgaacgacacccgctcccgctccccatgcgtatgtagcggccatatttaagatgacgcccttctgctcctgctcgatccaatgccttgccgcggcttggctgcagaaaaatgtgccgtttaaaacaatctcaataacagctttccatccattgggcgtcagcttctctgccgggcaaataaaattgccggccgcattgttaatcagcgcatcgagccggccaaagacttttttcgcttctgtaatcatgtctgaagcggcggaatcagaacggacatccatttgaaaacaggcgacctgcccctcaaaggtctcaatttctttttttgtttcctcaagtgcttcatggttcctccctgtcaccatgacgtgccatcctaattcagcctgttttttcgccattgcttttcccatgccgctcgaaccgcctgtaatgattaccgctttcttatccataacaaacccactccttttattgaatgaataatcattcataattttatcatagatgtctttccgcgtcattacatgctgagaagggatttttcagccaggctgatgatataatagaacaactctgacaaaggttggttttacatatggagaaaatcacgagaagaacatttttaaaaagaggattcggcattttgggtgcaactctcgcaacggcttgcggaggttacggctatgcccggtatattgaaccgcgcatgattgagatcacccgtcatacaatcaccagccgcctgatcccccgcggctttgacaattttaaaatcgttcaattcagcgatacgcatctcagtgatgtgtttacatccggtgacttgaataaagcagcggaaaagatcaatcagctgaaacccgatctgctcatctttacgggagatttaattgataagccgcatttatttaatgatcaccagcaagcactggccgtgctacaaaatctggaagctcccttcggcaaactttgtgtttacggaaaccatgaccacggaggctacggtacgaacacgtacaaggctctgatggaagcggctgattttcaagtgcttcgaaatggctgccgtcaggtgcagctgacagacggaagccggattgaattcgcgtttttggatgatgtaatgctcggaaaacccgattatgaaggcaccctttcccgcctttccgaagatgcgttttccattttaatcgtccacgagcctgatgccgctctcaagatcggcggatatcccgtaaacctccagctctcgggacacactcacggcggccaggtccagctcccgtttttcggccctctcattacgcctccatacggaaaaacgtataccgacggcatgtatacgctgcatgacacagccgtttacgtcaatcgcgggctcggtacgacaagactgccgtatcgatttttagccagaccggaaattacgctgttcacattgaaaaccgtacaaaaataagacttttatcccgatgcacagacaccccctccgtaatatgtatatggaaaagagcaaaaaggagggtgatgaaactgctgacatatcaagtgaaacaaggagaaaccatctcaagcattgcgcaagacttcagaataagcactgctgctctccttcaggcaaatccctcaatccaatcggtcatatacgcgggacagcacattatcataccgaatcttcccgacccatccaccattccctattccattgtcgtgtatatcggagcgaagaaactggagttataccgcctcggcaggctcatccgtacgtaccccatcgccgtcggaaaaatattgacgaccacgccgaccggagaattttacattgtgaaccgccagcctaagcccggcggcccgttcggcgcttattggctcagcctctctaaaattcattacggcattcacggaacaaataacccttcctccatcggcaaagcggtatcaaaaggatgcatccggatgtataatcaggacgtcactgaacttgccgctaccgttcctaatggaacaagggtgacgattataagatagaaagatcttatttgttaatggaacgagctgatgataatatattacagtgggacctttagggtaaggagcgtgtttatggatatatttaaaaatcgcaattttgtccgtctctttttcgcagcactcgcttctcaaatgggaacgactgtaggtaatatggctttcgctttttacttgctggaccatttttcaaaccagccggcatacacaactttggctgagctgatgtattcactgccgacagttttcgtatttctgattgtcggtgtcgcagctgaccggcttgacaggaaaaaggtcgcagagaattgtgactggatcagagccggactgacgatcgtattgtttgccgcattatacaccgggagcatccctctcgtgttctgtattttgttcatcagaagcgccgtgaccaagttctttttcccggcggaagccagccttgtacaagctattctgcctaaggagcattatgcgaaagcggcgggacttaaccagatcctgttcagcatctttatggtattcggcgtcggtatgggcgcgtttatgtataaaacgatcggtattcacggagccattatccttgattttgtcagctttattgtatcaggctttctgatccgcgcctgccgcattccgaaagaagcccgtcagccgaacggcccttttaaatggggagattcgtttctgaaagactcggtcgctgattttaaggaagggatcgtatatattgttaaaaacaaattgcttgcttcccttattttcggcttttttatctttggttttgtcaacggcggctttgccgtactgccgatgtttacgatgaaatacggacttgcgcctgatcattacgaatcacatacttccatcttcaccgtcgcactcggcttcggcctgcttgcaggaagtgtgatcggaacaatgatcgcaaaaaaagtcaaaccgcatcatttgatgtcgattcctattttggcagccggactgctcatttttgtcctcggctatacggataagctgtggatttattatgcggcggctttcatcctcggcatgtgcatcggccctgtcaatatcgccatcggcggctggatgccgaaaatcgttcatccgaaaataatgggccgggtcagcggctggcaggatccttttatgatgtttgcccaatcgattacactcggactggttgccctgttatttccgaaattcgtttccaatattgattacctttattacggcatgggaatcgtgattttagcggtatttgtgttctattttatcgctcttccgaaatacagcgccgaggcagcagaggtcgatgtgcagcaatcattaaaggctgattccgaaaaacatgcgaaacctgtctaataaaggaaaaaaatgcgcccttttcatcagaaaaaggcgtatttttataatcaatatttgcatttcaacgctaaaaaagtataatctatatatgaacttgatcaatgcaaaggagagaaataatggacgaccacgcttattcgaaagagctgcagccaaccatcgagaatctttcaaaagctgtttatactgtgaaccgccatgcaaaaaccgcccccaaccctaaatacctttatctgctgaaaaaacgggcattacaaaagcttgtgaaagaaggcaaagggaaaaaaatagggcttcacttttcaaataatcccaggtttagccaacagcagtcagacgtacttatctctatcggagactactattttcacatgcctccaacaaaagaagacttccagcatcttccgcatttaggtacgttaaatcaatcgtaccgcaatcctaaagcacaaatgtctttgacaaaagcgaaaaacgtattgcaaaaatatgtgggcttaaaggaaaaaccgcttgccgccaacaggcagcagcccgcttatcataaacccgtatttaaaaaacttggtgagagttatttttaattccgccgcaaaaaagccgatgcgtcatgcatcggcttttttctattcaatcacgtacgtatccacttttttaatgagctcgctgatttcaggcttgctgatctgttcatccgctccgactacttcgccccggtggcgcaggtcgtccgtaatcagggacgagaaaatcataatcggcacatcagagctttgcgggttatccttaaggagcttcgtcaaacgatgcccgtccattttcggcatctcaatgtcactgataatcatgtcaatatgatctgacaggtttgctccgttatccgtcagttccacgacgtaatcatacgcttcttttccgttttcaaatgtgacgatttcactgtaccccgcctcagtcagctcatccgtcaaaagacgcatcagaagcggcgaatcttcaacgatgatcagttttttacccgcccgtctttcatcaaatccttcctgatggacatgataagtctcaactccggatgccgattcaatatcgtaaatgatcttttcataatcaggcagaaagatcatcgtgtcttccagtttgatgattcccgttaaatgccgctccatcccctggttcagggaagtcggcttttcaatcgcctcccaggacaccctgtggatttgtgaaacggaaccgacgtgaaagacgattttccgcttgttgaattccgttacgatatatttatcgtcttttgctccttcggcatcaacgccgaaaaaggaatacagactgatgacgggaagaatttcgcctctcagcttaatcatcccttctacgtctttatgagactgaggcacagatgtgacatctaccggctgaatgatttcccggactttcatcacatttatgccaaatgtattgacgcctacttcaaatttgacgatttctaattcgtttgtgcctgaatccaataaaatatcgtattgttgtaaagacaattcaatccctcgctatccgcattcagtattgtactgtatatatcggctgtaaacggaaaaagtgaatgtattcgggccaactggccatgaactctttataaaaagatgcttttttctgatatcccattgactttttgacatcgagtggtaaaatagtcaaggatttttcaggaagaagggtgtaataaatgggtacagtagtcatattcgaccaagatcaaatgacggtgttagaagatatcagcaaaacggcttacctgcaaatgaaaaaagaggcgaaagagcgtcccgacaagcccgctccatacatcttatggcgggaagacgtcagctttgaatacgggtattaatgacattcgccacatatcacaatagatagatcatgatacaatgaagacaatcatttcagctggttgtcttatttttttctgaaagaaggtatgttttcacatatcggacatatactcgggatagttcaataaaaagatgacaaatgctcagctagtggtaaaataggataaactcaatatatagtataaggtgatgaattatggaacatttgcttaatccgaatgtaaaagaaattgaaatttcaggaattcgcaaattctcaaatcttgtagctcagcacgccaatgtcatttcgcttacgatcggccagccggatttcttcacgccgcaccatgtcaaagcggctgccaaaaaggcaatcgacgagaacgcaacggcatatactccgaacgcgggcggccttgagctgagacaggccgtacagctttatatgaagaaaaaagctgatttgaattatgaggctgaaactgaaatcatcgtcacaaccggggcaagccaagcgattgacgcgtctttgcggacgattttatctccaggcgatgaagttattctccccggaccgatatatccgggctacgaaccgatcatccgcatgtcgggcgccgttccggttcatgtggatacgacgacacacggatttaagctgacggcgcggcttattgaagaatcgctgacaccaaaaacaaaatgcgtcattcttccttatccgtcaaatccgaccggtgtgacattgtctgaggaagagctgcaaaacatcgcagccgtcctgaagggcagaaatgtttttgtcctgtctgatgagatttacagcgaattaacctatgacagaccgcattattcgatcgcgtcttatttgagagaccagacgatcgtcatcaacggcctgtcaaaatcacacagcatgacgggctggagaatcggtttcattttcgcaccgaaagaaattgccaagcacatcttaaaagttcaccaatacagtgtgacatgcgcgtcttcaatctctcagaaagcggctcttgaagcggtgacaaacggtgttgatgatgcgcttattatgagagaacagtataaaaagcggcttgactatgtatatgaccgtcttgtttcaatggggcttgacgtcgtaaagccgtcaggcgcattttatatcttcccttccattaagtcattcggaatgtcatcgtttgattttagtatggctcttttagaggatgcaggtgtggctcttgtgcccggcagctcgttttcaaagttgggtgaagggtatgtgaggctgtcattcgcatattcactggatacattgagagaaggcttggaccggctggaagcatttattttaaaaacgagagaatccatgcagactatttaaacaacggcataacgccgttgtttttttattgtttcgggaatgtaatgtgaaaggccgtgcctctgtccggtttgctgtctacttggatggctccctggtggtttttaataaggttgaatgtgaccatcagccccaggccggttcctttttctttcgttgtcaaaaacggttcgcctattcgtttcagcacgttttccggtatcccgtcgccctcgtctttcaccgtcacattaacggaatactcatcttctgtcatgatgatgtgaaccgttcccccatccggcatcgactcaacggcatttttaatcagattgataaacacctgtttcagctgattttgatcaccgttaatatacatgctgtcatgttcgtaatccgttttgataaaaatccctttaagattcgcctgcgtctctaaaagagcggtcacttcacttataattttctttaagtttacacgctctttcacggcgttttgctgaggtttggcaagcattaaaagctcacttaaaattaattcgattctgctcagttcagaaaacacaatttcaaagtaatgttcgttttcctccatcgtcggcttcatgagctgtaaaaatcctttgatcgccgtcagcggattgcggatttcgtgagcgatccccgccgccagctgccctgcgatagacagcttttccgacttcagcattaattcctccgtctgcttccgctcagaaatgtcacgcagaatgacctgcacggccgtttctccgaaaaacgtcgtcggaatgcagaccatttccgtgtagatcagccggtttttaaaagtaaaccacgattgcttaataatttctgactcggtctttcggttgataatattttgaatccgctgtttcacgccgtcatgatcacagggatgaagctgatcatagacgtttttcccgattaaatcttcatatgtttcagcctcaaacaacgaaatgcccgactcattcatgaacacccatttatcattgtgaatcacggcgatcgtgtcaattgaattctgaatgaggagctgataacgctctctgcttttttgcagaatcgtttgaaattttttccgtgaagaaatatcaatcagaagcagcaattccgcccgctgatttttatatgtcgtcggtgccgccttcacttctaaatgaacgggcgtgccgtcgagccttctccacgtctgttcgatcattccgacttccattcctttttgcatccgcacaattcggtttttcacaatgtcgtgatactcttcttcaataaactcataagagcgcctgccgattacctcgtctttgctttcggctcccagcatggcaagcatcgcgttgttggcgtaggcgattgtgccgttgatgctgacatataaaggattcggcagcatttcgacaagacgctcgaattcgccgtttccagccgcatcttcagactgttgttctgccttttgcttcttttgttcatacatataaggccggcggggcgtcttctcctcaagcaccttgattttgaggatgatttcccgatccgtcccctccatttgcggtgtgacaatttccacacccgcttcaagccatacgatggtatgatcttttttaataagacgaaaggtgcaaggcatcaaatgatgctcattatagaagtaactttcaaccaaaaattgatcttcttcatgcaggaacgttttgagaaatgacccgatcatctcttcctgagaataactgaagtacgatttacagtttgcggaaatatacataatacgcccgttagacgtcaaaacggcatgaagatcggttttcgattgaaactgtttgacatgctgagtatcctgttccacagaatccctcctttgcattatactcgcactgcaggctggacacggactgatataaaaagaaattccactagattgattcgctaaaaaatgagcattctccttctattcttattgtgaacgtcaattttcctgaatgaaagaaagggcgcacgatatgttcggccgccctttcatttgttattttttattgtatttcttttcaagttctttgtaagcgtcaattgctcctttggcaatgtttttgctgacgggatcgtgatcatcttgaacagacggaacgacgacgctgaatgccactcgtggatgttctgacggataatagccgacaaaggtcaggttatacgtatctttcccccaccagttcttgttcgtgccgtaatagtgcgtctgcgcggttcccgttttaccggaaacatcggcgccggacccctggaatgttgaataagccgttccttgaggtgagcttgtgaccagtttcattcctttatgaacttggtcaaaatcgctcggactgttatttactttgttcaaaattttaatatctcgctgttcaatcgcttttccaatcttgtttttgctgtccggttcatgaatgcttgtgacgatccgcggctggacgcgatacccgccgtttgcgatggctgaaatatattgagccatttgaagcggcgtatacgtatcaaactgtccgatcgcaaaatccagcagcaatcccccgaccaattgcggatttgactgcatgcccgctgattcctgcggaagatcaatcccggtcttcacacccaaaccgaattgggcgtagtagttgcgcatttttttaatatcgtctaatccggcaggcagcgtaccgtgcgggacgtaagtaatgccggcgatatgcatggccacatgaaacatatacacgtttgaacttctttgcagcgcagtcagctcagtaatggctcccatttgtgtccacgattgttttttcgtgtcgcctttaaatacaagcggtgcatcgacaaacgttttataatgcgggaggccgctttggtaacccgcgagaacagtcgctcctttaacagaagagcccatctcatattgggtcgtaaatgctccgatcgcaaaatcctgtgttttatttgtttcgagatcgatgcgtttccccgccattgagagaatatccccgttgttcgggtccatcatgacggcaaatcctctgtcaaccatatagttgcctgcagcgcggcttcttctcagctctttttcaatgactttttcgactttcgactgtaattccatatcgagcgagagctgcagatcgtagcctctgctgccttcatcgacgggcttttggctgacgacttcacctttgctgttttccacatactctactttttctttatgtgcgtttaaatagtcttcatactgatattcaatgtagctttttcccacccggtcattcagtgagtagcctcttgtgacataataatctttccgttcgcccaacaatccctgttccggggtcgtcacaccgccgaacagagagtacagcgttttatcgtacggatatttccgcgtccagtcattgattacgtcaatgccggggagctctttcaggtgctcggatacgacggaaacttcttcatatgtcaggtcgctttttggtttttgcttgttgttttcatgctcgtcaagcagtgaaccgctgtttccgtttccgttcagcttattcgggtccattgatttaacgacttgcggctgataggcgttgccgcttgaaaaacgcgtataaatcgccgcgatttccagctcttttttattttgtttgatcgcatcaatctcctgcttcgggacgcgttcaatctggcgtttgtacacttcttgggatttcaggctgttttctgaatccttcataagcttttccgccttcttcggatgtgcggcaagccagtaatcaatgatatttcgatccttcataaattcagtatcaatatgaatcagtgcggcgagattttttgccgttttcaatttgtcctttgccgaggtttttgaggtagaaacgtatacaatttcaggcacagcctggttatcaaccgccactctgttccgcttgtcatacatctttccccgcggtgtcggataataggcggtttttgcatttgccttctccgcatcctggcggtgtttatccccttcgacaatctggacgatgccgagtttaaaaatcagtgccgtaaagagaagaaacacaatcaaaaaatagagattcattctcagcgctctgtaacgtttcgtttttttctttggttcgcgcgcgacttcagccactttctgttacacctctcaaatcattgaatatatttacataaacagattttaattgtaacatttttgtaaaagttgttacagcgaaaacgggtaaaaaaaactgtcaagatcaaattatcttaaaatatatctaacacttcaaataatttgaagagatgtaacggatttttttaaaaaatacagatcgtttttcccggtatagagccatttttctgcgctcaattacaattatgacaagagtttgttgtcaaaggaaatggctgcctgcattatgacaaaaaagctgtgataagatttttcatgtagaaaaaaacaacttctctgggaggctataaacttatgaaaaaagcatttctcttatctgccgccgcggcagtcagtttgattacattcggaggcattcagcagacatctgccaaagagctgtcatgccagcacgtcgttaccgtgaaaaaaggaaacaccgtacagcatctgactcttcaagaggctgttgaaaaactacatatgaaaacgagcgtgaaaaagctgaacgttaaaaatgagaaagaactgaaacagcagctgcaaaaacacgcaaagcattctgatatgacagttaaagacgttcaaaaaggaacaccggcaaaaacggctccggcagctgccgaaaaaccgaaagccgatcaaaacaagacggctgacaatgcaaagcagacagataacacaaacaacagcagcgagaagactccttcatctgtcagtgcgtacgaaaagaaagtcgttgaattgacaaatgcagagagacaaaagcaaggcttaaaacctctgcagattgatgaaaaattaagcaaatcagctcacgcaaaatcacaagatatgaaagacaaaaactatttcgatcaccaaagtccgacttacggctcacctttcgatatgatgaagtctttcggaatcacttataaaactgccggtgaaaatatcgccaaagggcagacgactcctgaagccgtcgttaaagcttggatgaacagtgaaggccacagaaagaacatcatgaatcctgagttcactcaaatcggtgtgggttatgtagaatcaggaaacatctggacacagcaattcatcggaaaataaataaaaaaagattgcccggcgggcaatcttttttttatttcacccaaagcttataaatgctttgagttccgctgttttcttcaccttgcgcggaaagcttgtcgtacaatgatttggccagcgccaatccgggcatttcttctcccatgagctctgcttcttcaagagcaattcccatgtctttaataaagtgtttcacgtaaaatccgggcgcaaaatcgcctttcagcatacggggagcgaggttggacaatgaccagctgccagccgctccggttgtaatgcttttcagcacttgttccgggttcagaccggatttttccgcgtaacccatcgcttcagccactccgaccattcccgctgcaatcgcgatctgattgcacattttcgtatgctggccgctgccagccggcccttgatactgaatgttttcccccataacggagaaaagcggcaggcatgcttcaaacgcttctttttctcctccggccataatggcaagcgttccgttcctcgcgccgatgtctccgccggaaacgggtgcatccaaggcgtgaatggacttttctttggctttttccgctattttcttcgccagagacggttttgatgtcgtcatatcaatgacaaacgccccttcttttgcgtgccggagaatgccgttttcgccgagatagatttcctcgacatcactcggatagccgaccatggtaataataatgtcagctttctctgaaaggtctttgaccgtctcctgccagaccgctcccttattcagaatctcttctgctttttgtttcgtccgcgtgtagactaaaacaggatagcccgcttctaaaatgtgcgatgccatactgtttcccatgacgcccaaaccgataaatccgaccgttttgttcactgcgctttcctcccctgatgcgattcatatatcactctttcatgtctatattaccatattataggctgatagagaccgcgtcacaaggtgaatttagaaatggcgctgatcagatcttcgcttgcgctctttaacatatcagtcgattgcttcactttttcaagcgtaacgagctgttcatcagtagaagcattcacttcttccgccgctgccgcagattcttgagaaatggcggagatgctttgaatcgcttcttgaatcgcggcttgttcttcactcattttttgaatgtcattgtaaatatgatctataccttgaacgagagactgcatttccgtcgtaatcagattgagaacctcacccgtttcatgaatggcgctgttttgttcatcattcattctgcttgcctcaatcatcgcgtgtgacgcttcttttgtctcagattgaatcagacggaccgtctcactgatatggccggaagaaagagctgattgttcagcaagcttgcggacttcttccgcgacgacggcaaagccccgtccgctttctcccgctcttgcggcttctatgctcgcattcagcgccaagagattcgtctggtctgaaatagcggatattgccgtcacgacttcttctatgtttttcgtttgttcttccaggtcagtcagcattgcctctacttttttcgtttctgaattggcttcgtttgatttcatcagcagctgcccgagcgcgtccaatcctttgtagctggcatcctctgaagattttgagagtagttttatgctgcctgcgcgatctgcgattccttttattttgactgagagattttctgatttttcgttgatcgtctcaacctctgacgcttgctctgtcgctccggcggcgacttcctctatcgcttttgcgatttgtccgctcgtttcatttgtttcttgtgaaatgacggttagctggtcagatgtatcagacacattttctgaggaggccttgacctgttcgaccatctctttcatattttcaaccatttggttaaagtcttttgttaactcgcctacttcatcttttgatttcgtctgggcgcggacggttaaatctcccgctgagactgaatttgtctttgcgatcagctgctgaatcggcccggttatcgtttttgcgaggaaatagctgagtccgatcgtaatcacaagggcgatcagtgacataaaaatgctcaccgtgttcattttgtcggctactcccatcagctgatctttttcaaactgcgttccgactttccaccctgtttcttttaccgtttggtagacgaccatgttcccctgcagctctttgatgccttctttgtccgcagtgatgtcttttaacgtctgatcttccgaaatattttttccctgttttgccggatgggccagaagagagccgttttcatccgccaaaaacgcaaatcctttatacggaaccttttgctcgttgaccatgctctgaatggaggacagcttcaaatctaagctcgccactccgacgacggttccgctgttttgaatggcttttgacgccgtcacgatcatgtctcccgtcactgcatctttataagggtcagtccagacaaccttatcgggtttttcagccgccatcttataccacgttcgatttgtcggatcatagtctttggcaaaatcggcctttggatatgtaaacatttgtttgtttgcggttccgacgtacgcaagcgcgacatatttgtcattctgtccgatctgttttaactcatcgttaaaaagccgcgcggtttctttcttcccatctgatagaaaagaccgggacaattcaccgtctgctaatctcattaatacggtctcatcatttttcagctgaagctcaatgttctgaccgagtgaattggtgacattctctgtcgtacgttttgcttcctccgtcatcatcggctttaatgtcaaatatgaagaaaccgttaaaaaaacaaccgttacaataagcattgccgatacaaacacagcaattttgatatgcatttttttaaacataaccatcccctcctgagagttatatcggtctttcggccaagaaaatgaataaatcttgaaataaatatcaaacatttccgtcatttggcgcagcaaaaaaaagagccgtcatgccgacagctccgccttacgtaaaatattcgattttcgctttcggaaaataggtttcgatataagattcgagtgtttcccttaaggcatgttcttcgtctttttggtatatatatttgccgattccgtagcgtccccatttgtacctgcgcttttcttcatcaagctcaagctttgttttcggatagttcttctcaatcacccgtttggccggttttgtaaaacgatgctggatcagttcaaatgtgatgtcatgccgaacgtctttatcaagcgccgcatccagtttctcaaacagctccttatagccttcctcccagccatcgtgaatataaataggcgccacgatgaaaccgagcggatagcccgctttagcgactttgacggcggcttcgatccgtttgtcgagcggagaagttcccggttcaaagtttttaatgacataatccgcattgatgctgaatctgaacctagtctttccgttatgttttgcatcaagcaaatgatcgacgtggtgaaatttagtcacgaatctgagctgccccaattcgctttgtccgaaatgttcaatggctctttttaatgtatgtgtcagatgatcgattccgacgatatcagacgtacaagaggcttcaaatcttgtaaattccggcgctcgttctttcatatactcatcagcctgatccagaatctcttctacattgacatatgtccggatgtaaggctttgaccccatcgtcgtctgcaggtagcaatagtggcaatgccccatacagcctgtcgcaaatggaatggcatattcggcggacggctttgaagaatcgaatttcagtgttttccggacgccgattaccaatgttgatttcgcgttccggtattgctgcaagtgatttttccccggaatattccggacttgattatgcgatgttgtttctctgatctcaagccccatgttttcaaacttattcttcagctcttgtcctaacgggtattcgagcgctctcggttctatataaacaagctggggcacaaacggcttcagcatgaactgacactcccttttttcatattctcatgttgttactttccgtttaaaagagagtgaatatgcgttgtaaacatttcctttgatcaatgatatcggtcttcttcaaaaagctcgctgtaaagcgcttccgcttcctcatatgttgaaaagaccgcgtcatcttcggccagcggatgataggtttcgtataaaaacagagacagttctccctcatgatatgggtgatggacgatctccgcctctttaatatgggcaacattggcggcatgcggattgcggtaaatcacatagaccgtatcccccgctgcaaatgattttgtcataataatccctcctgttgaacgttattgttccccccttttttccgaatatgaaaaaaaccagacggcttataccgtctggctgttgtattacttattgaatgtttctttaacgaatgcgacaacctcttctgtcgtgctcatagacaagattgtttctttgaatgattcagcttcttttttagaaagcttgctgatctgcgttcttgccggaaggatggatgtagcgctcattgagaactcatctaagcctaagccgagaagaatcggaatcgcaatttcgtctcccgccatttctccgcacattccgacccatttgccctctttgtgagcggcttcaataacaagggtgatcagacggagaatcgccgggttgtatggctgatacagataagctacgcgctcgttcatgcggtcagcagccatcgtgtattggatcaagtcatttgttccgatactgaagaagtcaacttctgtagcaaactgatctgcgataacggctgtagacggaatctctaccatcataccgacttcaatatcgtcagaaaccgctacgccggcttcgacgagtttttctttttcttcgagaagaatcgctttcgcctgtttaaactcgtttactgtcgcaatcatcgggaacatgatttttaagtttccgtatgtacttgcacgaagcagcgcacgaagctgagttctgaagatttcttgctcttcaaggcaaaggcggatggctctgtagcctaagaacgggttcatttctttagggagctgcaggtaaggaagctctttgtcgccgccgatatccaatgtccgcacgacaactgattttccttccatacgctcaagaaccgttttataagcgtcaaactgctcgtcttccgtcggaagctggtcgcgtcccatgtaaaggaattccgtacggtaaagccctacagcttctcctccgttttcaagaacgccttttacatcgtcaggtgtgccgatgtttgcggcaagctctacatgatggccgtcttttgaaacagtcggttcattgacgagcttcgcccactcagctttttgcgccaggtaagcactgtgcttttcttcatatttctttaacgtttcactggaaggatcgatgatcacatcaccatcgatgccgtctacgattaccgtaacaccgttttcaattgtccctgtagccgcttttgtgccgacaacagccggaatttcaagcgaacgggccatgatcgcggagtgtgaagtgcgtccgccgatatcagttgtaaaaccttttacaaactggcggtttaattgcgccgtatcagacggtgtcaaatcttcagccacgataacaacctcttctgagatcatgctcgggttcggaatttccacgcccagcaggtgccccgtcacacgttttgttacgtcacggatatccgccgcacgctctttcatgtattcgttatccattgattcaaacatagtaacgaacatggaagctgtttctttcaaagcgaattcagcattgactgaatctgtgctgattttctcctttaccgggttcagcagctcaggatcactcagaactaaaaggtgcgcggagaaaatgtcagctttgtcttgtcccagttcttttaaagcatgctctttaattttttcaagctcttctttagaacgtacaatcgcttcatcaaaacggcttacttcagccgcagcatcagcaatgtttttcttttcaaccgttaagtccggctcttcaagccggtatgctttcgcaatcgcaattccggctgaagcgcctattccttttaattcttgcattactcgccgagtccttcgcttttcattgtttcttctaaagcgttaagagcatcgttttcgtcagcgcctgaagcggaaattgtgatttcagcgcctttagcgatacctagagacataacgcccatgattgacttaaggtttactgttttgccgttatattctaagtttacgtcagcatcgtatttgcttgcagtctgtacaagaactgtcgcaggacgagcgtggattccggaatctgctgttactttaaatgttttttgtgccatgattatcattctcctttaaattaaagctattttactacacaatattatatcatacagccgtacttgtcatctgacaagcacggcgtatttatatgcttattttccgattttcacaatatctttttgttcccgttttacggtaccttcggccgaaagggaaatcgcttcaccctcggcaagatttgtaaagacaatcggtgtcattaatgaaggaacatgaggtttaaccgcttcaagatcaacttcaagcagcttttgccccggttcaacccggtcaccctcagaaacaaaagaagtgaatccttcgcctttcaggctgactgtgtcgattccgaaatgaatcaggatctctcttccgccgtcagactgaagaccgatcgcatgttttgtcgggaaaacattcagcacttttccgcggacaggcgatacgacgattccttcttcaggaagaatcgcaaaaccgtcacccatcatttttcctgagaacacctggtcaggcacatcggtaatcggatggatttcgccggtgatcggagaagcgaacacttcttcaccctgctcgtttcggagcggatctgcgataacctcctcaacctgctggctgacttcttcttgtgcggatactttcggttcagggcgcggcgtgcgtccggcgataatatcctgcatctgtgtttttaaaccgtcagaacgcgggccgaaaatggcctgaatgttgtttccgacttcaagaacgcctgaggcgccaagctgtttcaaacgagtcttatccactttcttctggtcgttgaccgtaacgcggagtctcgtgatacaagcgtcaaggtgcttaatgttttcctggtcacccattgcctgcaggatttcataaggaaggtcgccggcttcgcctgaggcgcccgcaccttcatccgcagcctcttcttcacggcccggcgttttcagattgaactttctgatcgcaaaccggaaaccgaagtagtaaataacggctaatcctaggccgaccggaatgacaagccaccaagccgtccggttaggcagaattccgaacaggaagtagtcaatcagaccgcctgagaacgtcataccgatttttacatgcagcagctgcataaccataaaggaaagtcccgcgaatacgcagtgaatcgcaaacaggataggagccacaaataagaatgagaattcaagcggctcggtaattcccgttaagaaacttgtcagagcggcagaacccatgattccggctacaagttttttcttttcaggcttcgcttcatgatagattgcaagcgctgccgccggaagaccgaacatcataaacggatatttccccgtcataaatgttcccgccgtcagctgtacgccgtctttgatctgagccatgaaaatccgctgatctccgcggatgatgtctccggccgcatctttatagctgaaaaattcataccagaacggcgagtagaaaatgtgatgaagaccgaacggaatcaatgaccgctcaatcatcccgaaaataaaggccgccaaggttggattcgcttccacaagacccgtggagaaggaattcagaccgtgctggatcggaggccagatcactaacataataagtccgagaattaatgcggaaattgatgtgataatcgggacgaaccgcttacccgcaaagaatccgaggtactgcggaagttcaattttataaaacttgttgaacaataacgcggccaggaccccgacgataataccgccgaacacgccagtcgccaaagtgggtatccccagcatgttaatataggccggatggttttccgcaaaaaactttgcccgttcaattttgtcagacggaatactgccgttcgccataagcacggcgctcatggatacgttcatgaccaggtatccgataatggccgcaattccggcaacaccgtctccgttggcaagaccgatcgcaacccctactgcaaaaagaagcggcaggttgtcaaatacgatttggccggcgctttccatgacgttcgccacaagctgaacgttatcattgcttaagaaatgcatgacttgaatcatatctttgttctgcatggcattccctaacgcaagcaagatccccgcagccggtaaaatcgcaaccggaagcataagagcacggccgattttctggagaacgccgaataatgctttaaacataaaagatgtacctcctctgttagctagtgtgaccttacagcgaaaattcatgacaacgaattcactggcgcaagtcttcagtttaaccgtttacatttgcccttttacacaacaaaaaaggcatgagtaaaaagggtgtgcaaaataacgggatcgttcttcccgttttttaccctcaatcactcatgcctgatcgaatcagtgacacgtttttaaggtttcaactgaaattatgaaattttattggttaatcggtacaaatgaagcgtgagataaaccgcttccgcctcatgaactggttttttcagtatttgctgcaagatttttatcagtttccaagcagtattgtagcatagcgggtattcatttttcaataataacattaacttttctggttcttttgtctgctcttcccgattaatcctgtctatggtaaatctgatatgccggatcagccgcaaatagtggacgctttctttattcactttcatctggaaagagtcctcaatcacctgaacgaggcgggacatcagctgcgaatgctgattgacctctgaaaggggccgattcgtcagggcggaatggatatgcagagcgataaagccgatctctccttcaggaaggcagattcccgtcttttcattaatcatgccgacgacttcacgggcaatttggaattcttccggataaagcgtttcggtttccatgagaaacgggtttttaatgtcaaacccctgctgcagccgctttaccgcaaaggcgatatggtcagtcagcgcaatatggatatgctcatttaacggttggcttgtccgcttcttgatatgataaatgacgtcattggagatgtcgacaagtgtctcgtccacataaccgaggagctttttaaattgtttttgttctttttcatcctttaagatgaacatcttgtcataccctttatcttcaatgacatccgcttgtttttttccaaagccgatcccttttccgattaagacgacctcactgtatctatcatgtgttgcgatgagcacattgttatttaataccttttcaactgtaaaggaccccttcatgatcctcagctcctttgtcattcaatacctcatatcgtacaaaacgaacggaaagcgcgtcaattctttttttagacggttgatcgttcaataaggcggtaatcaagaactttccttcccggaggcccgccgctgatccggttctcaagcatgtgaaaagcctgctttcccatttctttcgttagtatatctattgtggaaatacctaacatcttgctgatatcatgattgtcgatgctcaaaatcgcaagctcttccgggatgcgcgtcccgtttgccttggcttcaaggtaaagacctgcggatacttgatcattcgccgcaaacagcgcagtcggtttgtcaccccagctcttccatctatgaaaaagggctttcccgtcaagcagcgtcagcaccttttccacaaccagctcttccctgtaaggctgcccgatcttcttgagcgcctctttgtatgcggcgatgcggacttgactgttttttcccttttttctggccaggctgatcgctattttccggtgtcccttttctatcagataatccagaccgtgccgaaatgcttcccgatgcggattactgatggaggaaagccctgccgcatcagtgtactggcagaggatgagcggttctttcacggcaagcaaatgctcatcaggaattgctttggagcagataatcaggccgtccacttggcgctcctgtaattgtgataaggcaaaacgttctttttgctgctcataatctgtctggtataaacaaagatgcacgcctgacgcttcggcagcctcggcaatacccgcaacaaggtctgcaaaatacggaaggttcaccgacggaagcacaacgccgatcatatcggaaaaacctttggataaatgcacagcatgaatgttgcgcgtgtatccgagcgattgcatcgcttttttcactctttctcttttgtccttacttacataaggatgatcgtttaaaactcttgataccgttgtaacggaaaccccggcagcgccggcaatgtctctgatcgtagccatggcgtcccccctttctttttttcccttgatctggaatgcgtttcatacagtaagctagaaacagatacatcctatccgtttgaaaggagaagaacagcgatggggattctttgcttaatcggtttgtgtctggccatactcggcggcagttaccttgccctgcggcccctgaatgaaaagcatgacatcaaaccatttcagcattttgatgattttttcatttaaaaggtgataaaaaaggacgctgcgttccagaaccgtccttttttatcacaaagctttctatttcagaatcgttaattctttcggatactgcgttaatgcttcggcgccgtcttttgtgacaaacacatcgtcttctatgcgcacgccgccgacatccggcacgtaaattcccggttctatcgtgtacaccatgccttctttgaggagtgtgtcgttcgcgctgctcattgatggatattcgtgaaccgaaatcccgagtccgtggccgaggcggtgcgggaaatagtctccgtatccggctttttcaataatgccgcgggcttttaaatcaagatcgccgattctgacgccgggtttacttaattgaagcgccgtctgttcagctttaagcaccgtttcgtaaatctcttcctgtttcgggctgattgattggtatgcgaatgttctcgtaatgtctgaacagtagccgtcaagaataacgcccagatcaaacagaacaaaatccccttttttcaaccggtctgcacccggattcccatggggctggcctgatttttccccgaacagcaccatcgttgaaaatgacatgccctgcacaccttttttcttcagctcaaactcaatctgcgcgagtacttcggtttcactcacaccctctttaagcgccgcgacaccgacttcaactccgtaatccgcgagttttgccgcttccctgagaatgctgatttccttctcatctttcacgagacggaattggttgagcgtttcttctgccgaaacaaatgccgcgccccctgaagcttgtttgagctgttctgagcgggaaagagagatcgaatccttttcaaccgcgatggaatcaagcggcacatttcgttttgtgagctcggctttgatcagctcccacggatcttcgtgatcgccgtagccgataataccatgctcccatccggcgctgcgggcttgtccggcttccattcccggacaaacgaaaaacggctcctgttcctgaaacaggaacaatcccattaaccgctcatgcggatccgtgtaaaaatcagttaaataaaatacgttttcctttgtatgtataaacgccgcatcatgtccttcttttttcagccaagatgaaacacgttctaatctgttcattttttgcttttcctccttaccaaagtgactctttattcattctatcagttttccggcgtttatgctgtgaacgaacattaaaaaaacagccgcccgatgtgcggctgtcatgtttattttaataatctcagtccgttcagtataaccagaatcgtgctcccctcatgcccgattacgccaaacggcagttccatcacctgcagaaagttagcgcagatcaaaaggcagatgactgagagcgagaaaacaatgttctgcttaataatccggttcattttccttgagagtctgcacattttcacaagcttgtgaagatcatttttcataaggactaagtcagccgtttctagagccacgtccgtgcctccgcccatcgcaataccgacgtcagcggttttcagagcaggcgcgtcattaatgccgtctccgaccatggcgattgtgccgtacgtttctttcagcttcttcacttcttttgccttttggtccggcagacaatcggcaacaaccgtcgtcatgcccgcctctttcgcgatggcagccgcagtttcagactgatcgccggtgagcatggctgtttgaatgcccagtgattcaagctcagccatcacggctttggcttcagggcggatttgatcctttaaggcgaagcagcctgcaatccggtcatcttttttaacaaagaccagtgtaaagcctttatcctttaattcttttcccgatgtctgcaaaaaagcatctgccgcatgttcacctgcaaatcccgcttttccgaccatccatttgacgccttctatttcagcctgaacaccgaatccggacgtctcgtcaatcgatagatggcctgcggggccggcgccccggctttcggcaaattcagctatcgcttttgcaagcgggtggcttgattgcttttctatcgcatacaccgcctgcatgatctcatcttcactcacattttccgctgcttgaaatgccgcgactgccggctgtccctttgtgaccgtgccggttttgtcaaatgcgatcatccgtacgcttcccagctgctctaaaaacacacttcctttaaccaataatccgttgcgggccccatttgagataagggaaagcgcagcgggcataatagaagcaacaagcgcgcacggggaggcgaccaccataaacaccatcgcccggtaaaaggtttcactccagctccagcctaaagcgaaatgaggaacgaataaaagcaaagccacggctaaaagcacgcctttgacatagacactttcgaatcgctcaataaatgcctgagccggtgacacgctgttttgggctgattccaccagccggatgatttttctgaataaagactgttcatttgttttcgtcacacggaccgttaaggagccgtttccgtttaccgttcctgtaaacacagaatctcctgctgttttttccgccggcatcgcttcacccgtcagcgccgattcatcgaggctcgtcacgccagactcaataatcccgtctgccgctacgcgttcgcccggcttaatgacgatcatgtcaccgatcttaagttcagcagccggcacccgcttttcccgtccgtccgcaagcagggtcgcttcctccggttccaatttcatcaaggatgttaaatcacggctgcttttattcatcgtatatgtttcgagcgcgccgcttaacgaaaaaataaagataagaactgcgccttccgcccaataaccgatcagggcggagccgacagccgcaaatatcatcagcagttccacatttaacgccttcgtctcaatggtatcctcaattccctcttttgcttttgcaaatcccccgatcaggaaggcaaggatatacaaagtgacggacaggccttttgtttcggtaaaaaaccaggccgcaagaataaggacgccggatacgagcgccgcaatgagttctgcatgctggagccacctttttccggcccgctcttcttgtatctgctgttgtgaatgggtttgtgtcatcacttgttcattcattatgaattctcctctctaattgagaacgcaaatcatcttcaattccccgataaaagtaaaacagccgcctgacaggcagcattttcacagtgttatcgcagtgttttctttattatagcatgccggcggaagatttcaattataattgttttaatttctttttgataataattatcattagcgtttcttcagctgttcattatatgcaaaaaaggtgcgggaggaattcctcccgcacctttttatttctctgaccattcttttaattgtgagacggtcatcggaccgacgatctttttttcgatttctcctttttcattcagcagaaatgacgtgggaatcgtcatgacatcgtattccttcataagctcgcctttcgtgtcaagaacaatcgggaatgtgagatggtgctgagtgacaaagttttgaacggtatttttatttcgctcggcattcatcaaatttaccgttacaaggcttacatcatcggactgatgctgttcaaaataggtttggaattgcggcagttcttttttgcacggcggacaccacgatgtccaaaaatgcaaaatcgttttctgccctttattcggaatcgatatttcgtctccttcaatcgtcttcatcagaaacacggcgggaactgcctgtttttctgatgaggcttttgcttcaggcatccaaacggcggcagctatcaaaaggactgcacatacaattagacggtttttatgcatatgatcttcctttcacgcgtttcggatagcttgcccttccttattgaaatgtatcagccttttcagctttcgatccggggagctgttcttccgccgcccgtcaaaaacacggagacaccgaggtctttgcagatcgtcacgtaatgtaaacttgtcagaagaatcatgccggtattcataccgagtataatgccgagcatttgcaattccggcatagaaccgagcacatacatcattgaaagccctacaatgctgctccatacgttatgataaaacgccgttttcacgtggccgatgccgatcagacaggcttgaagcggcatcacaaacagatgaaaaagaaaaaacggccacaaaagctgcaaataatactgcgcttccggagactgaaaaaacaaatgggtcagcgggcccgcgaactgaaacatgacccagaccgccggaatgccgtagccgaatgtaataaaaatcgcttgtctcagccgtttcagcacaatatcatattgggacagcgcatacgcttctgaaatgctgggaatcataacgaccatcagcgaatgggcgataaatgcgggaaacgaaccgattgtcatcgctacaccggcaagcattccgtattgatcaatcgcggcggtcccggctgccccggacgccagcagcgctcctttaaccaagaagggttcaattgcgtttgtcaccgcatgaaatatacgaagtcccgttgtcgggatggatacggccaggaggcgtttccgtacgtctttcccgcgaagatgaatgtgctgatggccggaaagcgccctccgcgccaaaataaactgcgtatacagataaacgaacaccacaacatcgcttgcgaccagcacaaataacgaaataagcacggccatatcaatttcaaaagagtaccattgaaaaaagataaacagacaaagcacttgaatgatttttttcaagacattcgcaaccgcgatttttcccatttgctgcacacccataaaataacctctggcgatggatgtaaaagcgacgactggaatcagcccgatgacaatccctttaataaacgggtgatacgtatcgaatacaggaatgaacggcagcgcgatgcttgcggccgcggtggaaaacgcggtaaaaacggcggtcattctgaaggcatgccggagcatgctttcatgcagcttctgattggattccgcgatgaattttgaaatagagatcggaagctccagactggcgatcacgataattaaaaaaatggtgggcagaatgctcatgtaaagccccatcccatgctcgccaagctcccgcgccagtatcatattcacgacaaattccagacattccgcgaaaaaggcggcgatggataaaagaatgatccctttcacaaatcgattcatggtgtctctccttgtctcacgttcttccatcatcatatgagacaagttctgaaaatattttcgatttctcaaaattgaaaaaagcatagcggggttatttttgatcccgctatgcttcttacatcgcaaatacgtgtctgccgatccgttcgataatttttcgggaacggatccagtggtcagatgccgttttcggattgtagaaaaacaacgcgttcgtttctctgcccggatggtctagcgcctcatttgcggcggcgatggaatccttatccggcttttgattaatgcttccgtttgctaccggttcaaatgcattcctttgatagatcacgccccgaatggtatccgggaaaccgtttttttcagtacggttcagcactacgctggctaccgcaaccttccctttataagattcacctttcgcttctgcgtgaacgagacgtgacaggagctgtctgtcagcgcgggaatacgtttttttcggcggctgataagccgtctcgtccggttttgctttcttctcttggtgagatgacagctttatcggttggatagagtgcttttgatccgtttctgagagcttcggaaccgggctttttttatttaaatcagcaaccagtgtgctgggttcttgctttggcttcttcgcaaaagtaaacagagcttctgtatgttcaatttttgatgcaggcataaaacatagaaaaaagacagccaaggcagcaaattttgtcgtcatacgatttcctccttaaatacttcactaccttaacaagagctgtacgcaaattcacggttaaagattttccaatgctcccaatcagcttttatgatggaagaagtttgttaacagccttgttattggcaggaaaacagccgtcattttcacaacattaaccaaatagcagtaaaagtatccatcggagggattttacattttgtttacatctgttacagtcagatgaaataagcagcgaaaacaaaaaaagactcctcaagtgcgaggagccgtcagcttcttggctgttctaaatactggaagataacatctccgccctgctgggcaataccgcggaaatgcttaaaatcttcctgcttcgacaaaaccgctcgaaatgcaagaaaatgttctttctgcaccctgaattctttgatttcaccgatgcgcatttggttgatacgttctgaaatttcctcaggcagcaacgaatacagcctccttttctcggctttttcccgaaaaacaatataccatctttcccccgccgggacaatgattgagcgggctgatacccatatcgctttacttcttaaagaaaatactgcaaaatattttcaaacaggatttatgataaaggagaggaagctcgtgaaaattgctaaggttggaaacgtcattgaatttaaaaacggattaaccggtattgttgaaaaagtaaatgaaaactccgtcatcgttgatgtaaccatcatggataattatcgtgaccttgaattagattccctcactgtcgtcaaccataagaattataaaatcatcagagactcctattaaaccccccgaacaatccgaaccatttacatatcccgcacaaaagctgccgcccggcagctttttcaaatgaattcagatctcggtcatttccacaaaaaaatcatcggtctcatctttattgtaaagatttgtgacggatgtatagtagttggttattttaccgcggaattcaagcccacgctcgggcgccttgatgtcaaatgttttttcatacaaaaggacggcaatatcatgatacgtttcagaggtcaccttcaatacgaatgaaatcatacggccgtttttacccgcactttctttacaatcatacattttcagccttacaccgtttaactctaacggctccataacgaacactccttctttttacaggacatgctaccatgctggccattcctttacaattgatccgctccgaataagaaaaaacagcgcagccctttacaaacatacgttccctattttataatgaaacagacgagctgccatccagcacccgtcacgtattgaagcggcgagtacactccccccgggtttactcgtctttttcttttctccaaatgatctctcttttccttatagaagttctgtgcaaatatcatgcacctttttggctgcgtggcagagacgaaaaatacccccgcttaaaaggcgggggtatttaggttatagtccgagtccgtactccgtctgaaattaacgattatcaatcgtctccggatacatatcatgattcatcatccgatgttcggccattttttcgtattttgttcccggtctgccgtagtttgtatacgggtcaatggagattccgcctcttggcgtgaatttgccccatacttcaatgtagcgggggtccattaattcgatcaagtcattcatgatgatgttcatgcagtcctcgtggaaatctccgtggttgcggaagctgaaaagatacagctttaacgatttgctttccaccattttttcgtccggaatataactgatgtagatggttgcaaaatccggctgtcccgttttcgggcaaagcgacgtaaattccgggcagttgaatttaacgaaataatcacggttcacgtgtttattcggaaatgattccaaaacctccggcgcatattcaaataaatagtttgtcccttgattccccaggagcgtaactccttctaattctgattcttttcttgtcatataaatctccctttctattaaactccccgtttattgccccaaagcaatgtatgcagctgaggcaggactctgacgagattcagatccgaatcggctgaaaccttatcaacgagtgtttcgtattttccgagcagatgtgcgatcaatgcccggtcgtccgtcgtatggacgttatcgtttccgacctgaagataaaacgggatattcggataccgcttgtgcacggttttcgcgaattgcagatcttcatcattaaaaatgacgacctttaagctgaccgcgttaagcctttctgccgcatcaagcgaagacataatgtgatcgagctttgcaaaatcggttgtcatccccgaacttggcggcttcggtgaaatcgtcaggtcgttaatcattgtgaaccaatcctgatagactgttccctgcgtttctaaagcggcgcgcaccccgtgctctttcagcagcagaatcagcgcgtcaagctgctttaacagcgccgggtttcctcctgagatggtgacatgagaaaaggcgtctccgccgatttctctcagctcgcggtaaatgtcttccgccgtcatccagcggatatcttttttggctgatccgtcccatgtaaaagcggagtcgcaccagctgcaggagtagtcacagcccgccgtgcggacgaacatggttttctggccgataaccatgccctccccttgtatcgtcggtccgaaaatttctaataccggaattcctttagccattcctatcaccttttttcgggcggtatacgcaatagcttgtcggggtttccctgacaaaaacctgcacgcagaccggctgattctccagtgtttcgaggtaggactgcaccttatcgtaaatcgttttggccacgacctcggtcgtcggcagtgaatatctgtcatcatcagaaaattcctcatggtcattcagcaatgtatggtcataagcgccgtgcaccaatttcttcagcacgctgaaattcacgagaaagcctgaatcgtccagttcatcccccgcaactgtaatatttactgtatacgtgtgcccgtggactctgctgcacgctccggcgctttcgcggggaataaagtgcgcggctgaaatgtgcatgtccttattcaactcaaacgaataaggatgctgaacctgcgggtaaatttgagaaagcaattagttccgctctcctttcattttcatatattcatcatatcctttattgcgaagcaggcatgccgggcattcgccgcatccgtccgcaatgatgccgttatagcaagtcagtgtgttattctttacaaaatcaagcgcgccgagctcatccgcaagtttccacgtttctgctttgttcagccacataaggggcgtatgaatgacgaacggcttttccatcgccaagttgacggtgacgttgcaggatttgacaaactcgtcacggcagtccgggtagccgctgaaatcagtctcgcaaacaccggtaataatgtggcgcgcgccgatttgatatgcaagaatcgatgcaaaggataaaaatacaaggttgcgtcccggtacaaaggttgtcggcaattccccgtccttcgcttcaatttcgatatcatctcttgtcagcgcattcggcgcaagctgatttaaaagagacatatcaagcaagtggtttttgacaccgagcttttcggcaatcgattttgccacatcgatttcttcttggtgacgctgattataatggaatgtaacggtttccacttcttcaaagttttgcaaagcccataataaacaagtcgtgctgtcttggcctccgctgaacaccacaaccgctttttcttttttcatgtctttctctcccttatctatcattccataaaaaaagcgcctttttcggagaaggcgccctaaaaaacataaaaaaaccgtatccaaggatacagctcgtccttagttttttatagagggtgtagctagaacctctcccgcatcaatacggattttcttcttttttcacttttgctatcataccataatgttgtttcccgtgacaataaaaaaacagcctgaaccctgtgtcaggctgcaaaagcgggtttaagccccgcgtttcttccccggaaatgccatcagcgcaatcccgatcagaacaaataaagcaggccagaaaacagaaaccggaatgatcggctgatacgtcatcataaagcaaagtgctgtcaaggtcagcactgcaaccggaatgagcagcgccttctgtttcccgccgaacagccacagctcaaataaaccgaatgccgttgccaacaggtaaacaggccatgtcacatcggagtagaaccaattggttgccgtttcaaagacaaacaagatccccgtgatcaataagatgccgcccggtacgagaagccccgcgtttttgacaggtttcgggccgaaaatcggaatgtgaaaagcggcgcccagcaacagaatgagagcgggccagccgcgttcgctgatgacttcatttgcattggtgaatatgccgaaaatgcccgcggcgcacagaaccgccgcagcagtcaaaagccctctttgccttctgccgaacagccaggcttcaaacagcccgaatgcaacggcaaagaggtaaacaggcgatgtcatcgttgcgtatgtccaatccgtcagcgtttcaaaccataacaagccgcccgtcacaagcaaaatgccgcccggaataagaaggcccgatctttttttcggctgcataaaggcagcggcgtgaaacaaaagcgcggctgcgatgatcaaaagcggccacagccccgtcatcagcataccggcaaagcatagtgctcccgcggctgtcaggataaaagcaggaatcaatacgccgatctttctcccgccgaaataccacagctcaaacagaccgagagcaggcgcccatatataaacaggccacgtcatgcctgaatacgtccatcccgttgcggtctcaaaacaaaacaggcagcccagcacaagaaacataccgccgggaacgagcagtcccgcctgttcaggcgtttttttcgcaaaaataaatccggcgtgaaaccctgcggacattataatgaaaagaaacggccacgccgaacctgcggatatatgtataactcccgccttctgtaaaaaaaacgtaatgccgatacaaataaaaataaatcccaataatacacgtcgatccttcatctcttactcctccccatcatttcccaattcattatacagaaatggcaggaaaaaagaaggggaattcccaaaatatacagacattttccttatatccttatttatctttcgggatttttttgcaaatcaatgcgccgatgaaagcgaggctcacatacccaaacaccggataaacggtggaaatcagctgtccgtaaccgatttggctgataatgaaagcaaacgccaaaatgccgccgtaaatatatgtactttttatatgaagaaaactgtttaattgtttttccaatccgtataaattgccgataaccgacgtaaacacttccccgaaaataataaacaaataaatgatatgaagcgaacgcgaatacgaatagacaacttgagccatcggaatgtcaaactccagcacatccggcagcaccgataatgataaaaagctcgcggcaagcaccagtgtcaacagaacgccgcctatataagctcctcttctgatcaccttctctgaagacatttcgttcgcaagcggcacaaggacggcttgggcgagcgataaatttaacgcgccgtaagagacggcggacaaaagccagttccacttgtcaggccatacccattcgtccgcgtttctcgtgcttgtaaatacaaatgaatcagctgtcacgataaaagagaaagaaattaaaagcggcacaaccaatatattgacgccgaacacacctttaacaccgcttgtcatgacggcaaagctcagtacgatcgtcagaaggatccccgcttgtgcgggccagccaagctgttcatgaaacagcgctccggctccggacagcatgacagaggtcactcccagcaatataaacatcataaacatgttcacggcgcggccgatggactggccgaataaatatgtgttcaattcctgataagatgctgcatgaatccgtttggaaataatcatgattttggcgcctaaatatgtaaacatcagaccgcttaccacgataccgaacagaccgatccagccaaacttcagaaaaaactcaacgatttcccgtcccgtggcaaaaccggctcctacaaccgtgcctacgtatacaaatgcaagctgacttgcagaaccttttgtttgtcccatttcaccctccggctaaacgcagatttgtccaggcctttatatatgcttatgagacaagtctctcgaaaagacgaacaaatcgtccttccccggaaaaaacagattcagctctctcctctaagcaaaaatattgaaagaaaaaaagggccggcgtatactcttcatcaagaaaggtcaaagcatttcatttcctttccgactatattggtcaaaaataatcaaacctcacgaatatcacttatcatgctgtaaacatttatttttcggggtttgaaacaaaatacttgaaagtcaaagaaggtcagagtatactgataatcaaagaaggtcaaagtttcggccttattttctaacccatttggtcaaagatgatcaaacatttttcgaggaggttttggcaaatgcgttgtcaacattgtcagaaaaacgaggcgacgattcgcctgaacatgcaagtcaattccattcaaaaacaattcgttttatgtgaaacatgttatacagaattaacccgaaaaccgtctatgagcatggggccgcaatcattcggattcccgtttgagcaaggtttcgctcccaatcaaaataaacagcaggccggccctgaaaaaggcctgctcgacgagctcgctcaaaacgtcacaaacggcgcaaaagcaggtctgattgaccctgtgatcggccgcgataatgaagtggcgcgcgtaattgaaattttgaaccgccggaataaaaacaatccggtgctgatcggtgagccgggcgtcggtaaaacggctattgcagaaggcctcgcgcttaaaatcgctgaaggcgatgtgccgaacaaattgaaaaacaaagagctttacctgcttgacgtcgcttctctcgtcgccaatacagggatcagaggccagtttgaagaaagaatgaaacaattaatgaacgaattaaaagaacggaaaaatgtcatcttgttcattgatgagattcaccttcttgtaggcgccggctctgccgagggatcaatggatgccgggaacatcctgaaaccggcgcttgccagaggcgagctgcaggtcatcggggcgacaacgctgaaagagtaccgccagattgaaaaagatgcggcgcttgaaagacgcttccagcctgtcatggttcacgagcctacaatagaacaagccatcagcattctggaaggcattaaagataaatacgagaaataccacggcgtcacattcagcaatgaagcgataaacgcctgtgttacgctttcatcccgttacattcaggaccgccacctgccggataaagcgatcgacttattagatgaagccggctctaaggcgaacctggaacttgataccgtaaatgaagaagatgcggctgagagactcaaagcaattgacgcggagaaaacaaaagcgcttcgggaagaaaattatgagcttgccgcgaaactgcgtgatgaagaagcggctttggaaaagcagctggcgcatgaaacaccggcctcttcacctgaaatcggcgcggagcatattcaagccatcattgaacagaaaacaggcattccggtcggaaaactccaggctgatgaacaagtcaaaatgaaggaacttgaagagcatcttcatcagcgtgtcatcggtcaggaaaaagccgtgaaaaaagtggcgaaagcggtcagacgaagccgcgccggcttaaaatccaaaaacagacctgtcggctccttcctctttgtcggaccgaccggagtcggaaaaaccgagttatcaaagacactcgcagatgaactgttcggtacaaaagattccattatccgtctcgatatgagtgaatacatggaaaaacacgccgtatcaaaaattatcggttcaccgccgggatatgtcggacacgatgaagccggtcaattaacggaaaaagtgcgccgcaatccgtacagcatcgtgctgctcgatgagattgaaaaagcccaccctgatgtccagcatatgtttctgcagattatggaggacggccgtctgacagacagccagggcagaacggtcagctttaaagataccgttttgattatgacaagcaacgctggaaccggcgaaaaacaggtgaaagtcggattccaatctgaagagagcgtcatggaagaacaaacgctgattgattcactgagcgcgttcttcaaaccggagtttttaaaccggtttgacagcattattgaattccaatccctgaaaaaagaacatctcgtgaaaatcgtcagcctgcttctcacagagcttgaagacacattaaaagagcgcggcatcagcctgagcgtcaccgatgatgcgaaggaaaaaatcgctgaaatcggctaccaccccgctttcggagcacgcccgctcagaagaaccatccaagaattgatcgaggacgaaatgacagatctcttattggatgacaacgaaatcaaagccttccatgtcgtaatggaagaggacggcatcaaagtccgggcacaataagaaaaaagcggctccctcctcgcggggagccgcttttttgtttctttctccatgccggaagggagaaactgtgaagaattcgggaacaatttctcaatcaccctaaagttccatgcactgccaccgatattaaccatagaaagctagtataaaggatttggtgaaaactatggataaaacatcgattatcggtatcatcctcgccgtgattgctttaagcgtgggcatggtgctgaaaggggtcagcttaagcgcactcgctaacccggcagctattctgattattttgttcggtacgatttctgcggtgatcatcgcattccccggaaaagaaatcaaaaaagtgcctgccctttttaaagtgctgtttaaagaaaacaaacagctgacaattgcgcaattaattcctatgttctctcaatgggcgcaaatcgccagacgtgaaggtctgctcgcattggaagcaagcattgaagacgtggatgacgcatttttaaaaaacggcctgagcatggcggttgacggacaaagcgcagaatttatcagagatattatgactgaagaagttgaagcgatggaagacaggcaccaggccggcgcagcgatctttacacaagccggcacatatgcgccgacactcggcgttttgggtgcggtcatcggccttatcgccgctctttccaacatgaacaataccgaggcgctcggacatgccatcagtgcggcgtttgtcgccacccttctcgggattttcacagggtatgtactttggcatcccttcgccaacaaactgaaacgcaaatcaaagcaggaagtcaaactgcgtgaaatcatgatcgaaggcgttctgtcagtgcttgaaggacaggccccgaaagtgatcgaacaaaaacttctcatgtatcttcctgcgaatgaacgcgcaaaagtcgctgaacaagaaggagaggcaaacaatggcgagaaaaaagaagaagaagcatgatgacgagcatgtggatgagtcttggctgatcccgtacgcggatttgctcacccttcttttggctctgttcattgtattgttcgccatgagctcggtcgatgcggcgaaattccaaatgctgtctaaatcatttaacgccgtgtttaccggaggcacgggtgttcttgaatattcaagcgtcacccctcctgaaaacgaaaaagacggcgttgatcagttaaaaaaagacaaggaaaaagataaagaacagaaaaagaaagaaagagaagcagccgaccgcgaagaacttgaaggcgtgcaaaagcaagtcaatcaatttataaaaaacaaaaagcttgaaactcagctggaaacaaagctgactaaagaaggactcttaattaccattaaagacagtatcttttttgattccggacgggcggacatccgtcaggaagatattccgcttgccaaggaaatctcgaatctccttgtgctgaatccgccgaggaatattatcatcagcggacatacggacaatgtgccgattaaaaactcacaatatcaatctaactggcatttaagcgtcatgcgggccgtcaacttcatggctattctcacggaaaacccgaaacttgacgcaaaagtattcagcgccaaaggtttcggagagtataaaccggccgtgtcgaacaaaaccgctgaagggcgcagcaaaaacaggcgcgtcgaggtattgatacaacctagaaacgccgcgactgaccaaaatcagtaatataaaaaaggaagcctttcaaacggcttccttttttatttctgatgaaaatgtttagcgtttaaccccactcttttcagcatttccgtacacatttctatctcttcatcactcagcacactgatcatttctttaatttcttcagcatgatcagggaaaatatcgtccaaaagacggattcccttttcggaaatttgtgcgaaagtcactcttctgtcagtcggcgaggcttttctgatgagaagttcttttttctctaatttgtcaacaacgtatgtaatacttccgctcgctaataaaattttgtcgccgatctgctgaagcggctggttgcctttgtggtacagcagctcaagcaccgcaaattccgtcgggttcagaccgtgcttatgaatatgtttattcatatggtcgttaatagatcggtacgcacgtgacagtacaataaataatttcaatgagttttctgttttatccgtcatacattcaatcatccttttacaaaagaaaccgttacagagaaacattaataaacaaaatgaaaaatgtcaacaaaaatgtttccaaaatttctcttctttttgtctggccttaataaaataatttgtttttctatcattttggttattttttcttattaaagaagtataaaaatgatataatacctctattcaagtgtaatgttggagcgatgcagagtgaatacatttaaaggtgcccggggaaagatcaaactttatctcatattggtgatcatcccggcacttattatcagctttttcatttatgaaaaagaaaagcagaaaatagccgataaacacatacaggaagccagtatgatgctcaaccttcaccgcaataagctcaattatttaatcggtgaaacaaaagcccggatgacaacacttgcgatcgctgtcgataagcctgtcaatgaagaaaagatcattgatattctcgatcaggcttttgaggatgaacccagattcagcggtctgtatatgctgaattccaaaggtgatgtcatcgcaagcacgactgatctgaaatcaaaggtgaatttggccgaccgaccgtattttacgaaggcgaaaaagacgaaaaaaacggttatcacaaatgactactccagcagaattacaggccagcgcatcttcacgatctgcgtgccggtgttagacgcaaaacgggaagtcacggattatttagtagccgccattcaagtcgattatttgagaaatatgatcaatatgctgagccctgacgtttatgtcaaggcaaccaatcagaataaagtgatatttgccagcggacgggctgatcaatcagaaggggtgaaaccggtcagcggctatctggatgatattaattggaatatcaatgtttatccgaaaccggttgagctgaacgagctgaccaaaagcgtactgctgccgatgtccagtattgccgtgctgctgaatattctgttcatcctcgtccaatattatctgcttaagcgcaagacccagctggagcgcgctcaaaatgaagcgcagaaattggagctgatcggaacgcttgccgccagcaccgcccatgaaatccgcaacccgcttacagggatcagcggcttcattcagcttttgcagaaaaaatacaaatcggaggaagatcagctgtatttctcaattattgagcaggagattaaacggatcaatcagattgtcagtgagtttttagtgctcggtaaacccactgctgaacggttggaagtgaactcgctgcaggatattcttgatgagattatgccgattatttattctgaagggaatctgtataatgtggaagtgaatgtggagattctcgtcaatcggccgctcaaggtcaactgcacgaaagaccatattaaacaggtgattttaaatgtcgcaaaaaacgcgctggaatccatgcaggaaggcggccggctgtccatctatttagaagcccgcgaccataaagcagtcattaaggtggccgacaacggaatgggcatttctgaagatatgcttgaacacatttttcttccgtttgtaacgtcaaaggaaaaaggcaccggcctcggccttgtcgtatgtaaacgaatcatgctgatgtacggcggttcgattgacattcaaagcgaagtcgataagggcacagaggtcaccattacccttcctgccgcttcacgatgaaaaaaacaccctgggtcggggtgttttttatttaaagaagaatatgtgtaagaggatataccagaggaacggcatcatagccggcagatagtacgaggcgcttcgtgagccgtgccagcggaaaaatctgctgactgtacgcggtcatctttcggatgcggcgcttgatcaggaagcgcattcagtcttcgttatctgttttatcatcaatcatttgtttgcttcatatgcaggcatgacgtcaccgcgggagaacaagcctattttcttcacaaggccctgtattccttggtgatgtgtgcgatcacggtttaccagctgctgatacgcgttcatcagacagtccagttcctggctgtgcctgatcgtgtcatatccggtaaacccttgtctgttagccgcatctatcatcatttttctttttttatcaatagatacaagcaatttttcttgttcagaataactgcccattcacttcacccctcaccgctaaaagaataggaaacaagtttgattgggttattgagcattattacagattatactttatttgtaaacatttttttactaaataacttattttttcatttcatattggaatctttagcatgaatacgagaataatacccattcaggtaatgatataaacagaatgcggcatattcaagatttaaaaaacagccacagctgactttatattacaataaaaaacctctcataccggcgggggcatgagaggttcgggcgtctatcagttttgcacactttcattttcgtaaatcggcacccagccctcagtcgtcacgaaaattcggattgcgacgacccggcggtcttcctgaagcgtaaagtagtggcggatgttctccggaactgaaatcaaatcgcccggatttaaacggacgtcgaaaaatgtgccgtctttgccttgaatgacgaagatgccgtgtccgctgacgataaagcggacttcatcatccgtgtggtgatgttctctttggaaattttttaataattcatcaagattcggcgtggtatctgataaagaaatgacatcctgagactgatatccgcgccgggctgaaatgtcctgaatctccgtgtcaaacgccgcgagaatccgttctttttcatcttctgtcagattgtatttctccgaaagctcagacggaagtttttcaatgttccactgctcatagatcacctcttgttcgtctaaaaagcgcgctacttcttcctgattttcaatgagcgtattcttttcgtcatgtattctgatggtcgccattttccgttcctccttttattttacaagctgcggccgcagtgacagaagcttgaggtggcagctgaataaaaattcataggcttccagcacccttttcgcttcaaatgcggtccgcccccatgccgtaatgccgtgattacggattaacaccgcgcctgagccggcgtccgcatggtgcgcgaagttttcggccaatgccgggatgtgcgccgggttgtcaatgatcggaacggtcacggacgcgttttcctcccataatccgagcgccttaatcatctcctgcccctgaaacgtgatttgtttttcatccccgtaaagctctgagatgacattattattaacggtatggacatgcagacagcagccggcttctgtcttttggtataagtaagtatggagaagcgtttccgctgaaggttttaaagaatggccggtctcagcgggcttcccgttctcatcgattaagagaaaatcttcgtctgtttcttttcgtttgtcttttccgctcgccgtaacgaggaaagtcagcggcgcgtcggatactttgatggaaagattcccgctcgttgccgggaaccagtctctttcggccagctcgcgctttacctcggcaagttcgcgccagcgttcttcttttacagccacgcctgcacctccccgatgttttcaatgcctgttttcacctcatgaaaatcttgaaaaggcagatgccggaggccgagttctttgcattcagtcaaaagataatctctcgcaaaacacatatcggataactttgcagcctcaacatccgtgaccgaatcaccgatcataatgagaaatttctgctgatcggacagcttccggatgactgacggtttgcagcagccgcattgattggtgcagcctccgtcacaggcgtgcggccagtctatatgaatatattcattgtcaaaggatgcatgattgcagaaaatccgctccttttctacgatcccttccaaaagcggatgcacaaaaaagtccattcctccgcttacgatataaaacgggaggccgtttgaccggacaaacgagacaaaatccaaaaagccgtcccgtattttcgcatccttcagaataaagtctgtcagttcttcttttaagctgctcggcagcagtccgaacatccggccgactccttcttggattgataggcttttagacagaacaccgtcttttaattcaatccactcagggggcgcgaattctttcatcatgctgacaatgttgtcgttcatggtgaccgttccgtcgaaatcacaaataatcagcggtgtgcgggtcatacggcttccacccttccccatttgtctaatgcgagctgaagatctttgcacgacgcggctttttcttcaatcggctgcgcttcaagcaccgcatcaatgatggcgcggaacgctcttccgccgccctcggctcctttcggatggccgtgaatgcctccgccggcattgatgatgtgatcgatgccgaaatcgcgcatcaacaatggcaccataccgggatgaatgcctgccgacgggacggcaaacgacggatgaaagacatcgtcttttacacattcatcatggattgcaagcgcggactccttcggaagagcaacggatccgtaaggtgacggaaataaactgaaatcagcgccgcaatagcggttcagcttgccgagcaaaagcgcatgcgacaagccgtaaacgggagatgaagtgaacgcgccgctgactgccggatgcgccatgatcggaagcgggatttccctgtcttctgcaaggctctgcatcacatctaaaccgtaagcgaacacattcaataaaagcgcgtccgccccgagttctgccgcgcgcctcgctttatcccgcagttcagcggtccttcccgtaaggtttacggcatacagcgttttatgccccgtctcctcccgggtttccttcaggacttgttttccttcgataatgcgggtttcaaacggagccagttcattttcaaagaaaatttcgtcatctttaatcagatccacgcctccgagcgcctgctgtctgagctgttctttaatgtcggcgagattccgtccgatcacgcctttaaatatgctcatcagaagcggtctttcaaattcgcccagcagtttgcggatgccgtatataccgaatttcggcccgggaagggagcgtttaaacccttcggaaaattcaagatcagtcaattttatttttccgtccaatgacagctttccgaataccgtcgtcaggacggccggaatatctcttgaaaagttcgcctcgggataggcgatagtgatgacggattgtgtttcgttttctgaggttccttctttctcctcaacttttacgacccggcctttatgttttctgagctgttcctgcttcaccaggggcaggtcagtccaggagcctaccgtcagccccgccgcaatctgttccgcccgcttttcactgtccgttgtgtctgtcagaagatatgttgccaatacttcgctcatgcgtgaacgcctctctttctttcacaaaacataaaaaaacctcttccgtatgagcagaaagaggcttcgtgttatgtccgaatcttatctctcagctcctgctgcaagaattagcaccgtgctttatcagtcggttgccgggcttcatcgggctcgtccctctgcctgctcttgataagaataatgattttataaagtattttgaattatcgcattgttatccagatatgtcaatgctttttcgggtgaaaagattcagtttcccgatccgttccgcagcttctttaagtctttcttcacttgtcagaagaccgactcttatatagccttccccccattttccgaacccgtttccggcagcgacggcgacatccgctttctcgagcagcagatctgaaaacgactgtgacgtataaccgtcgggcacagggagccatgcaaaaaaggagccagccggagccgtcacatcccagccgataccgcggcaggcttcaatccatgcattgcgcctcgattcatatctgtcattttgcgctgcgacgcatgcctgatcctctaaaagagcggctgccgccgcctgctgcgccgcgggaaacaggctgacaaacatatgatcctgataaagattgatcgcttcgatgacagaagcgtttccgacggcaaatccgacccgccagcccgccatattatacgttttggacaaggtatagatttcgattcccgtctcctttgcgccttccgtctgcaaaaagctcagcggtttatgcccgtcaaagccgacggctccgtacgcgaaatcgtgaacgacacaaataccgttttgttccgcaaaaccgaccgtctcctcaaaaaacgcctctgtcgccacagcgccggtcggattattcggataattgagatacagcagcttcgcctcgctccgcaccttttcaggaattacgctgtaatcagggagaaaccctctttcttccgtcagcggcatcatttccattttcgctttcgcaagggcgacgcccgaccagtaatcaggatatccgggatcaggcaccagaatggtatctcccgggtttaaaagacattgcggaagctcaacaagtcccgccttgcctccgaacagcacggcgacttccgtgtccggatcaagcgtgaccccgtactccctttcataaaatgcagcggctgcttttttgaagctgtaagcgccccggaatgatgagtatttatgattttccggcctttcgacggcgcgcttcatttcttcaacgatatgctgaggcgtcggctgatcagggtttccctgccctaaattgatgacgtctctgccttctttcagcttttgatttactttttgcaccaatgatgcgaaaaattgttccggcagctgtttgagtacatctgagatttcaaagttcatatttttcaccttctaaaaatgtcttgaaatgatagtccatcatcatatatggttaaataaaaaaagtaaagagaaacttgaggtgttaaaaaatgaaatggaccgtttcctgtttgcaatttgatatttcatacggaaatccttcagaaaattttaaaaaagcggaatctttgattgagcaagaaagccgccatgcggatgtaatcgtgcttcctgagttgtggacaaccggctatgatctcacacggctagaccagctggcggatgaaaacggcaaagtttcggaacaatggcttaaagaaacggcaaaaacatacaacgtacacctcgttgccggatcttttgcggtcaaagaaggcgaaaatgtctataacaccatgtacatcgccgataacagcggacagatcgtgaagcggtatcagaaagcccatctgtttcagctgatggatgaacacctttacttgtcagcgggaaacagtgacggttcctttgagctcgacggtgtcaagtgcgccgggctgatctgctatgatatccgtttccccgaatggatcagaaagcatacgtcccagggcgcgaatgtcctgtttatctctgcggaatggcctctgccccgccttgatcattggcgaagcctgcttatcgccagagcaattgaaaaccaatgttttgtcgcagcctctaactgcacggggtccaatcccgataatgaatttgccggccacagcctgattattgacccgtggggccggattttagccgaaggagaccggacggaaggcgcagtccgggcggaaatcgatgtgtcagaaagtgcggccgtccgcggaaccattccggttttccaagacttgcggcgtgatttatattaattttcaaaaaaatgttgacaagaatatccggcacctgctaatattttcatcaactgattaatccgaattgtgatacaaatcaatatattttctcttatcgagagttgggcgagggaattggccttttgaccccaacagcaaccgaccgtaattccattgtgaaatggggcgcgtacattttgcgccgagacgattgtctcataaggcacggtgctaattccatcagatgttatctgagagataagaggcggactgcactgtttcagcctccttctctttcagagaaggaggctttttttcgggcgtattctccgtcacgatctcttactgccactacataattggagggtaaatccatgtcagcaactaaaacaagtctttatgaacaattaacagaaagctccgccgccgcgttagccgtcaagctcggcttattccaaagcaaaagcactctgacatgccgtgaaatcggcgacggcaatttaaattacgtctttcatgtttacgataaagaaaaccaaaaaggactgattatcaaacaggcgattccttacgcgaaagtcgtcggtgaaagctggccgcttacaattgatcgggcgagaatcgaaagcagcgccctcatccgccagggcgaacacgtgccgcacctcgttccggccgtttactattccgatactgaaatggccgtcacggtaatggaagacctctcacatttgcagatttcaagaaaagggctgctggaagggcagcattatccgaacttatcggttcatatcggtgaatttttagggaaaacgcttttttactcatccgattatgcgcttgatgcgaaagtaaagcagcagctcgcaaagcagtttacaaatcctgagctttgcaatattacagaaaggcttgtgtttacagaaccgtttctcgaccatgagacaaacgattttgaggaggagctgcgcccgtacgcagaaaaagtttggaacaattcccggctgaaagaaggcgctgacgaattgaaagccatctttctgaattccgcggaaacattggttcacggcgatctgcacacgggaagcatcttcgccgatgaacatgaaacaaaggtgattgatcccgagtttgctttcttcggaccgatcgggtttgacatcggccaatttatcgccaatctgctgttaaacgccctcagccgcgacggtgacgacagacagccgttatatgaccatactgccgccgtatgggatacatttgtgaaaacattcagtgaagcatgggagaaagactgcctgccttcccgcagacacctgctggaagacacactgaaaaacgcgtttgaagaagcggtcggttttgcgggatgcgaattgatccggcgcacgatcggactcgcccatgtggctgacttagatgaaatcactccgtttgacaaacgaatcgaacggaagaagctggcgcttgagatcggcgcctattatatcgaaaacagaaaagaactgaagcatatcaccgaggttctggaccaatttaagctccgtgtaaaggaatgatgcagcatgaccaatgaatttgccatcccccgttctgtggaatggaaagaaacctacatccgcattttaaatcagcaaaaacttcccgacgtcactgagtatgtggaacttgaaacaaaggaagatgtattcgacgcgattgtcacgctgaaagtaaggggcgccccggccatcggtataaccgcggcattcggactcgcgctctccgccaagtcatttgaagcccgcgatctttcagatttccgacgtcagttcgcggatgtcaaagcgtatttaaacagttcgaggcccactgccgtcaacctcgcgtgggcgcttgacagactgacggattccatcagggatgcaatctcaatcaatgaagcgaagacaacgctcgttcatgaagccattcaaattcagattgaggatgaagaaacctgccgaatgatcggccaaaatgcgctgcacctttttaaaaaaggcgaccagatcatgaccatctgcaatgcgggctcgattgctacaagccggtacggtacggcgcttgctcccttttacttagcgaaacaaaaagacctcggccttcatatctacgcatgtgaaacaagacccgttctccaaggatcccggctgacggcgtgggagctgatgcagggcggaattgatgtcacactcattacggacagcatggccgcccatacaatgaaggaaaaacatatttcagcagtcattgtcggcgctgacagaattgctaaaaacggagatacggccaacaaaatcggaacttacggcctcgctattttggcaaacgcctttcagattccgttttttgtggccgcaccgctttcgacctttgacttgcagattgaaaacggcgatcagattccgattgaagaaagagatccggatgaagtcagacagatctcaggcatacgcaccgctcccgaagatgtgccggtcttcaatccggcctttgacatcacaccgggcagcctgatttcaggcattatcaccgagaaaggaattgtgaccggttcttacacggaagaaattgaacaattattcgccgactgtcagctgagctgaaaaaccgctgatgatgttgcctcaggcaatgtcagcggtttttttgtctgcacaatgtaatcacttcatctttttgggcggctgtaatgagatgcattttaaaaaacagctctgcataaccggctatcttttgcggacggctcattttcatcaggcttcgtcctcctttttcaccagaccaacttttttcacttaataaaatgatatgtcggacgcgaaaaaacggaacgtgccatatgttttatttttctttataggatatttgttcgatgttcagcagcaccgcttttacatccgtcttcgtgcccgcgtatcccgttaaggcgctgtttttgccgattacccgatggcacgggacaaaaatcggcagccggtttcgtttattggcttgtccgtggcgcgcaccgctttcggttttccgatcgcttcggccatatcgccgtagcttcgggattccccgtaaggaatcatcgtcagcgcgttccataccctttcctgaaagggtgtgcctttttgtctcaaaggcagagagaattgctttctttctcctgaaaaataggatgccagctgctgtttcgcacggctttacgccgggcgcgtctttccgccattcctcaaaatcttccccggtgagaaacaggccggtaataaagccctcttcctctgttacgataacggttccaaacggcgcttttacacttgtaaaacagatcattccccgctccttctttcttcggtattctgccggatcggaagcgtcaaatgaaaaaccgtgcccttcccttcttcactttccacatgaatgcgtccctgatgttcttcgatgattttatagctgaccatcagaccgaggcccgttcccctgtcttttgtcgtgtaaaatggctcgcccagacgttttaatttgtcttcggaaatgcctgttccttcatcttgaaaagaaatcaaaatgtggtcttgatcagaaggctggatggtcacgtagatattgccgccgcccggcatgacttcaatggcgttttttaaaatattgataaacacctgttttaattgattcggttcacagtaaatcggcgggatgtttccggtcaggttcagatgaatctgcacattgacaagattggcctgggcattcaaaagatcagccgtgtctttcataatctgcgtcacgtctttttcttcatataatatcgcctgaggtttcgctaaaattaaaaattcagtgatgatagactcgatgcgttttaattctgaggtaatgacgttaaagtacagggaatattcgccttcaatgcttccttgaagaagctgaatgaaccctttcagcgctgtcatcgggtttctgatttcgtgggcgatgcccgccgccagctcccctacaacatgaagagtgtcggatttccgcagcctctcttcaagttctttggcctctgtgacatctttaaagatggccagattcatattttgaataatatttcttttgaaggagaattccagtttgcggctgtcactgctgcttaacaggaaggggatttcattatccattccttctaaatcaatctttctggcgggaacacccgcgttttcaatatcaaataaagaaagaatatccggaacggtgtacgctctcagctcctcatccggcatgcccagtatacggcttgcgagaggattcgcgtcaataatgcggaattggttgtcaaataagaccttgccgtccattgagccgttgaatacttttctgaatttcagctcgctttcccgcaattctttttccatccgcttacgatcgctgacatttcttaaaatggttaaatgctgaccttcaagtatggttcgttttgatgtgaactcaagctctttgtattggccgtttgccatctgaaacagcatttcttcacggatttccccgtatttttcatatttcttcttaatctgcttgtattttttctgcggatcaacgataaacgtacataaattcgtctccagcagcttatccatcggcagttcgaaaatgcggcacgccgattcgtttgctttggcaatctttccgtcatcagaccaaatgacaatcgcgtccatcgcgttttcaaaaatttcgcggaatcgctcttcgcttttaaagagtttcaattccatcaaccgtttctctgttatatctctcataatggacatgtagaacccgctgattaagttggacgtaatcgtaaattcaaacagcttctcttcgccggaccgaagcttgacgggcagttctcctttggcatttccttttctgcggagggtttcccagatttctttcagatgctttttgttttcgccgtcggtaaaatggcggagcgacagatgcgacaattcattctggccgatctcaaagcttttgcaaaaagagaggttcgcatcaataaacccgccgtccttatcaaacagcacgatgccgtcaacagccctgtcaaacaaatctttaaacagctgctcgttcatggagaattcgcgctctaatatttttttagaggagatgtccctcatcaccacaaaaaaataatcctccccaattccgtctctggcgaggaattcaatgtatttcgtcgcgccgctgtcaagcttaatcggcacctctttccacagatggccttttttaaaaaactttttcacggccttattcagttcttcctgaggcacggaatataaaaagtccaggacggagcggttaataaggctctctgcctcaatctgcatcatccgggccgcagcctcgttcgcctggacgattttcatttccttacggcatataaaaatggcatcaagcgtgttattcataatcacatgataccggttcaaatcactcttcaggcggtcattttcctctttcatccgcttcagctgctctttcagcgactcgtttgtttgcaaatccagagtttcagccattcagtacactccttcttcaaaaacctatccttcaatatttctacaaaatacctcatcttccttcattcgccctatacatttcagaaaatttcaatgatatgacaagttaaagtctttttctacgatccttacctccccgttacatcatcctaacaatcccttttgtcctccttcaattttttgttttttattttaaaatgaacaccaacaggaaataatcatgcagtggatgatttttgaagagaaggtgatgctatgacaaaatcgcgagacagttactttgacaacgccaagtttatcttgatttttctggtggtgttcggccatatcctccggtcatttattaacggaaatgagtttatgctccatctctacaaattcatttatacttttcatatgccggcctttatcctggtttccggctatttcgcaaaaaactttaagcggaaaggttatgtgaagaagctggctgtgaagctgattattccgtacctgatttttcagggcatttactcggttttttactatttgattcaggatgaaagcatggcaagcgtcaatccgattgatccgcagtggtctctctggtttttagtcagcttattcttttggaatctgctgctttatccctttacgaagctgccgaaaatgtgggcgcttggggcgagctgcgggcttgccgtcatgatcgggtatctcgatttcatcagcagcacgctgagtctttcacggacgtttgtctttcttccgatgtttctcgtcgggttttatttaaagaaacggcactttgatttgcttcgggctaaaagaggcaggcagattgccgcgggcgtactggggattgttttcctcttatgctggtgcattgattttgattactcgtggctgttcggatcggagccttattctacattcggcacagtgtcgctgttgagcggtctgtcgcgcatcggctggtatgttttggcctttgccgccactttcagctttttggcgctcgttccgcaaaagcgttatttctttacgaaatggggtacgagaacgttttacgtatatctgctgcatggattcattataaaaacgctgcggcagatcgggcttgaagatcacttgtctgattatcagaatttagtcatgctcttaatgttaacagccgctcttacgtccattctctccagcaatgcggtgaaaacggccgcacagccgtttattgagctgcggataaccggcttgcttcaagcggtgaaaggaacaagaaacggtgcttattcgaaataatgcaaaatacctcttaagcgttgccgcttaagaggtattttttattttttgccgtcttcttttttcttcggcttcgtctgttcaagcgtttcaatccattttccggcgttataatcaccgagctcgcttgaaaactcttcttcaagcaatttagggtccatcggctttttatggttttgcatgtctttgctgtggcggttttttttcgtcatattactcgcctccttgtttgccgtgttttgatttgcggtttgcgcctctcagtccgggatcaccgtcatattgtgttttgtatgcatctttgtccatgctctcagtcggtgtattgttgttggtcaaagcttcattctttgctgctttgcgtttcatttgatttcctccttctgtcagcaaatctgttttgaattcattaagcattttttttaagtcgcgcactgtcacgtttttggcctcatcaatgagttcatagccgatctgtccgttcggctcaagcagcacatatttaaaatcttgaatgtctccgaggccttcctgcctgatcctcattgacagctggtcttcggtaaaacgcattttttttaagttttccgggatgatttttccgtttctgacaacggcgacggtttttcctgaaaataaaaactcaaaaaagcttgatttgatttctaaatattccatcagaatcagtaccgcaataaaaatcgccgccgcgaaaatggtttcccataaattatgttcaataaacggctgaataataatcgagccgatcgaaatcatgatgactgtctgggtcaccgacagctggctgatggatttccgtccggcaatccgcaataaaaaggtaccgaccgctatcataactaccgacttccaaaatacggcaaacaatgacgtcacctctttacaagtagaatctccaaagaaactgtttccactcatccattttacggcaataaaaaaacaccgctttctgaaaagcggtgtcagccgataatcatcctttccttcggataatgataatttgcttcgatttcttttcggccgatcaaataaaggaaagtcaaaatgccgatccggccgataaacatcacaatcatgatcacacattttccgatatcgcttaaatgcggagtaatcccgagcgacaggccggtcgttccgaaagcggaacacacttcaaaaagcagtccgaggagcgtctgatttgtctccgtcacggaaagaatcagcgtcgacccgaacacgagcagaattgccatcatcgtaacgaccagcgacttcatgacatcagcctgatgaagctcgcgtttaaagaccttgaccgctttattccctctggcaaaatgaaacagggcaagaaggttaagcgcaaacgtcgtcgtacggattccgccgccgaccgagctcggtgatgcgccgataaacatgagggcgcagatgaaaaataatgtcggcgccgacagctggctgatatcaattgtcgcaagcccgccgcttcgcgtagcagttgattgaaagagacataaaaataaaacatcatgccagcttttccccttcataacatggcttgcttcaagcgcgtaaatgcccacggctccgaacaaaacgagcattccgaacgtaacggtcgtaattttcgtaaacagcgtgaatgagtatctgcgctgttttgaaaacaaaaagtcttttacttctacgagcaccggaaaaccgatcgcgccgaaaataatcagaagcatcgtaataaactgcacgaaatagtcatgtctgaacgggacgagtgaatttcccgtaatatcaaagccgccgtttgtcgtggcgctgacgctcgcaaagaatccgtgcaagtacgcctgttcaaacgaatcatagtacgttaaaaaatatgttcctaagatgatgccgcctaaaaactcgattaataaaatcaaaaacagcacttgcttcatcaggttgacgataccggaaaactgcgattgattctgatccaccataatgagcttccgttcccgcagaccgatccgtttgcccataatgagccagacgaatgttccgagcgtcataatgccgattccgccgaattgaagcacgaaagccaaaatgacaatcccggccgtgctgaatgtatcagccgtgttgacgaccgttaaaccggtgacactgactgagctgacagccgtaaacagcgcgtctataaacgaccagctggccccttgtttgtgggcggccggcagacttagcaaaataaatgccaccgtcacagcaagaaaataatataatgcaatcagctgtgcaggcgacaagatctgtatgaatttcttcagttttaatttcataagatagttccttctgcctctcaaatgtagtacgtaattattctaatgatattgggagaatttttaaaggcctttttagaaagatttttcattaccttatgtaatttgccgatctttaaacaaaaaacctctgaaacgattgtcagaggttttgtttattattttgcttccagcctgcggatgcgctcatcgagatcagggtgtgtggagaacagtgacgaatgctttttgccgttaatttttaacgtctgcaccgccgtctggtcttcttcattcacatgtcctgtataagacttcagcgtacgcagggcgtgaatcattttatccttgccggcaaggtctgcaccgccgcggtcagcgtgaaactctctgtggcgcgagtaggcgaagacgacaagactgccgagaatggaaaagataatctgaaacacgatcatcgcgataaaatgcacgaccggtgcgaggtcttctttgacaaagcggcttgcaacccatgccgcgattcgggaaaggaatacgacgaacgtattgacgattccctgcagcagcgtcatcgtgaccatatcaccgtttgtgatgtgtgcgacttcatgggcaagaaccccttccaccgcagcatcatccatctgctgcaataaacctgaagaaaccgcgacaagcgaacggcgcttagaaggtccggtcgcaaaagcattgacctccggggactgataaatgccgacttcaggcattttcgtcatccctgcggcacgggacaatctgtgcacacggtcaaccaattgctgttcttcatagctgagtgactgtttcttcggatttaacacccggacgcccatcatcgttttggccatccatctggacattccgagagaaataaaagaaccgacaaaaccgacgacaagactgaacacgagcaatgccatcagatcaatgcggccattttgtatatacgagccgacaccggtaacgcttgtaataatcgtaagcacaattccgattgtcgtaatgaccaaaaggttcgttaaaataaacagaaatattcttttcgccataattacctccgtcttttttaagatcaaaagaacttatttaattaaattataaatgatctgtttgaaaatgcaacaatttcgacgtatgatgtaaatgtaattctcagtgatatcagaaagtgaacacgtaatcaatcagaggtgaaccatgaacacgtttaaactgacccgaactgatatggtccggcttctttacgcgttaaaaggccaaggagacgcaactcctctccaaatcttattgcaatcagcggaaatgacattggatgaagcggaaagccgtctgcatatccctgaatttctgacgagattcgaacgaaaaaaagagaaaaaggaatacgggctttcaactaacgagattgtcgagctgggaaatctgtgcgagctgacgtctttaaaatcaaccgccgtccaaaactgggtgaagcgcgatattaaagatttaatcggccaccccttactcggcaaaaaatatacaattgaacaagctgtcatccttctcattgtacgtgatttaaaatcaatttatgacttcgaacatatacgcggcatattaaaaatcgcttttaacacgatcacagacagatcagacgacgtcatcagcccgatcagctactatgaaagctgcgcccaagtgattgattatcttcatcataaagcaaacccgccgatgaaggaaacgagcctgcaggagctcgttgaagagcagacggacaagctcaaaggctgctttaaagaactcggaagcggacaatggaacaatatcagatccatcatcgccgtcacggtgctctccgttttgactttccatattcaagcctcagcctacaaaatgaccagccatttattataattcataacgcttcttcgccccggtgtctgcgccggggttttttgctgtacaacaattgccagcataatcaataccgttccgtttgaaactaaaatgcgtaaacacatcttgccagagaaaaggagatgaaaaagatggcgagcagaaataaactcttagttccaggggctgagcaggcacttgaccaatttaaatacgaagtggctcaagaattcggcgtgaaccttagctctgatacagcagcacgcgcaaacggctctgtaggcggggaaatgacaaaacgtcttgtacagcaggctcaatcacaattaaacgggaaaaatcaataatgcagcttattcgccgggacttctcggcgaattttgatatttatcggcattctcctttccgtgccggtagccgttcggattcctgcggtctgatgaatcttcatgatgccgataggagtcccaatgttcattgcgatcatgattccgctgattccagtaatgattgtaatacttttgcttaggctctttgtcatttccgttttcctgaggattttgtgttgggggctgctctgtttccccatcttgttccttctgtgtgttttcttctgatccggaagctgcatttttgtcggtttgctgactgccgtcctgactgtccggcttcgcttcttccgtgccgggcgttgtttcattgttttccggcttctctgctgccttttcttcatcaggagctgtcttttcatcagccgccggcttttctgtgtccggctgcttgctttgatcagcgtctgtttcggtatctttttgatctgtttcattgccgtcggtttgcttttcagactgtttttcttctgttttcttttcgtttcttcttatgtagctgcctgttgacatcccttcctgttttgctttttctcttgtttccatatcagattcaagagattggacctggtaggtgcccttatatttttcagtcatgtcagccagctgttttttaacgccttttttatatgtattgtcatctgtattttcataaaccgtggaaattaaaatctcttttgattcctttacatatccatgcttgctgcaatcggtaataatattattgatgacttccttaaaatcgctgcttttccaatctccgatgtcactgatgacctgtttggcgtcatggttcagcggtgtcagttcaatgacttcatatttgctgtttaaagccatttcaatgctgggattaatgtcaagcgtcatatacgcgtaagctttgttatcagaaaaaaccgggagcaaaattaaaataaacaaaataatagcagtcatcgtaaacactcccaatttaaaagggcgcagtttcagaaaatcaaaaaagctggcccttcttcccatacgcgtttcgccttcgaacgtaatttcctctccgatttcacaagtgcggtgatcattttttgtttttaaaaattgtccgtcaggggttagcaacgtgacgaattttttatttttctctactatgatccctcttctcatgagtgcaacacccctttaagataatcttttaaataaatataatcaccggtaataataatactcatggcgatgatatattttcggttccgttcgatcgtttttctgctgaccgacacgagctgctcaagctgtttgacaggaagctgttttttctggtgcaaaatggacgccagctcttcattttcaacaagcgtgtaggctaccttaatcgcattctgcctcgcatcagtatgcttcggcgattgttccagcagctctttaaaagacaggccgtattctttcagctgcttctgaaaaaaaagaatttcttcccggcgctgttcctgttctatctgtttgcggtattcatcaatggaaagctccgcttcgataaggctctgcgaagattcctggtcgtcgccctcctgcacatccatattgatatgctgagcggttcttgcttcttttctgatatagtctatcacttttctttttataatcagctctgcaaatgcaagcagcgaattacctttttcagccgaatacttttcaatggcttcgttaaacgcgatcagcccgatgctgaattcgtcgtctttttcatctatatatcgtttacaaacggatgaaaccgtcttcgcgataaaaggcttatattgctgtattaaatcgttctgcagatctttgtcgcctttttgtattttttcaacagatgtttcaagcgtttgcttcttttttcccaatttaaacaaaaggctaagcactggtttcacctcagttcctccctataactactcataatcatagctaatttagtagggattcgcaaaggaagaaaaagagaaatcgatttcatttgtctcaattatgacaagccaataagacgtactatacatgatttcgtgcccccatgcagaattaagggggttttctctgtgttttttgtaacaatgctgttataaaattgttatcatatgtcttaaatgtaagcgtttcaaacaaaaaagggaacctgctttttaaaaagccagactccctttttgatcattttacgcgtgttctcttttttccgatgccgcgccggactctgtttgttttgctcctgacataaaccatccgcaaaccgcaatggcagccagaaccgcccagaaaatgattttccaagccgccgaatgaatgacatctgccggaattataccgagttcctcatgggccaacgtataaagagcgagcttcacgcctacccatccgacaatcacaaatgccgccgtttcaaggcccggcctggttttcagtaaggatacgaacattgatgccgcaaaacgcataatgattaaaccgattacgccgccggctaaaataacgagaaactgaccgccgtccaagccgccgatggcaggaagccgtgttcccgggagcgttacggcaagcgcaaccgccgctaaaatggagtcaacggcaaaagcgatgtccgcgagctccactttcaagacagtctgccaaaacccgctttctttctgcgttttctgcccagcgttatctttgaatacataccgcttcagcaaatggctgaccgcaatgtaaaacaggtataaagcgccgacggcctggacctgccaaacattcaccaaaaatgaaatggcgaacagcgacccgaaacgcaaaataaatgcgcccgccaatccgtaaaataaagccttcttcctttgtttttcaggaagatgcttcaccatcacagccatcaccagcgcgttatccgccgccaaaatcccttccagcccgattaaaatgaaaagaacccatccatactccagtaataatgcaaagtccaatccattccctccgtttcttttttctatcatccgagcttataccggcggtttttttacgcaaaaaagacctttgccgatataaggcaaaggtcttgctagacatgaatgattggcatgccaacaaagccgatggatatgatccatgaattgacgactttgtttccggaatatccggacgctactcccctttgggatttcaagaaatatttgtttatacgctcatgataaagcctgtttcatcatttgtcaacgcttaacttttttaacaaattgagaaattttttctgttttgacccgctgttttcttctcttcaaaaacatccaaagaacgagaagcaacacaatgaatataccgagcggcagcatatattgatcgagaatggaaccgacgcttttccaattttccccgagtttcataccgaggtatacgtaagcaaatgtaatcggcagcatcgctgcatatgtatagagagagaacacccagacattcatcttcgcaatgccgcacggcaaagaaatcagcgtcctgacccccggtataaaacggccgctgaacgctaccaaacctccgtgcttctgaaagaattcatctgatttctgcagggattcgggttttatccatatgtactttccatatttcagcaaaaacggccgaccgcccagcctgccgatcccatataagacaagcggacctgaaacaccgccgagcgaaccggcaaacacggctccggcaagcgtcatatccccttttgagacccaatagcccgcaagcggaagaacaatttccgccgggatgaattctatactgagcgccaaaaaaattccggcgtaagataagcttttaaacgcttcaattattgatatgatgaaatcttcgatgatctatcactcccggcttacgtctatattctgaaacttaagaatgattttaacacaaaaccttgaggctgaaatatcttttagacatgcccgttataaatatagtcgtttcagatcggtatagcgggagggaatgacatgcgcaatacaacgtcccgcctgtctcctgattgctcgtctggcggcggttacatcacttaagatctccggaaagttaccatttgcggtaagcggcgctgaccggaattcagttcatatgggcagtgcgttttgccgggatctttgccatcgccgaatctgtttttatgggagcgggaaattctctcggtcactacatggaaatgcgtgggcatttcccggggaatgattctgtataatttttttgatcaaccattgatgattttcggggacttcagcgatttaaagaacttaccgattcacatgcgatttccttttcagccggccattaccgcatgaggaaatggaacagccgctccatgaacgccgcatcacccataagttgctacacatggaacggacccgtttatccacaataaagacaaaaaggagtttttattcatgcacacgatgtggaagggttcgatcagtttcggcctcgtcaatatcccggtcaagctctttgcggccactgaagataaagatataaaattccgcagtcttcataaagaagaccatgcgccgattaaatacgaaaaaatctgcaccggatgtgaaaagagtctggagcctgatgaaatcgtgaaaggctatgagtatgtaaaagggaaatacgtcattatgacagacgaagacttgaaagacgtaaaacaggaacatgaagaaaaagcggttgagattgttgactttgtccagctgcaggaaatcgatccgatttattttaaccggtcatattatgtcgggccgggagacaacggcacaaaagcctatacacttctgcgggaagcgctgaggacgacgggtaaaatcgggattgcctccattacgatccgctctaaacagcagcttgcgattcttcgcgtgtatgacaactgcatcgtgatggaatccattcattatccggatgaagtcagaaatgccggacatgtgccgggcgttcctgagcagacagccgttaatgaaaaagagctgcagacggcgatcacgttaattaatgagctgacaaccgagtttgacccggaacaatacgaagacacataccggaaagcccttctcgccaaaattaacgataagctcgaacatgaagaagcgggcgtgacacctgctcctgccggcccgcgagaagatgtcattgatcttgtcagcgcgcttcaggcaagcattgaccggacgaagcggccgaatcgcgaacaggctgcaccggcacggacaaaagacacagcgtcagcaggcggcggaggcaaaaagcagaagacgaccagacaaaaagccggaacgtcttaatcatggtgctgacgatgcagccgattttgacctctgtaccgcctgaaggcagtgagtggcgctatgaggtaaagtatgacggattccgctgtcttctccgcatagacgaaaacggtgttacattaaccagcagaaacggacagacgctgacgaatcaatttccggaaatcacggcttttgcggcccggtgttttcagcacatgaaagacaggttccccattacgcttgacggagagcttgtctatttaatcaatccgtacagggcggactttgagcatcttcaaatccgcggacgtttaaaacgaaccgaagcaattaaaagcaccgctgagagacggccgtgccgctttctggcatttgatctcctcgttctggaaggcgcgggcaccgtctcattaccgtatgtgaaacggaagcgcgccctttccaatctgcttaaagaagcaaatcttcccgcctgccctcatcacttagcggaagaagcgattcaatacattccggagcacactgactttgacgcgctttgggacaaggtcgtccgccatgacggagaaggtatcgtagccaaaagggcttccagcggatgggcggaaaataaacgctctcccgactggcagaagtataaacatatgaaaacggctcacgtgctattaaccggattcaatccgaagaacgggtatgtgacggcctctgttttgaaagacggcatcgtcgtcccgatcgcttccgtttcccacggcatgcaggcggaagaaaaaaacgccgtcagaaccattatggagacccacggaaaaaaacaaaaaagcggcgagtatacacttgagccttctatctgcatgaccgtgcagtatttaaccatattgcaggacacgctgcgtgaagtatcttttgtgtcctttcagtttgaaatggattggacggaatgcacgtatcagcagcttatcctccgctctaaaacgctgccgccgaagctgcagttcacaagcctggataagatcgtttttaaaaaacgtgaaaaaacgaaagcagatttccttagttatatggtgaaaatgagcgattttctgatgccctttcttaaagatcgggccgtcacggtgatccgttatccgcacggcgcgcctggcgaatctttctttcaaaaaaacaaaccggactacacgccggactttgtcacaagcgtgtttgacgggagccacgagcacatcgtatgcagcagcgtaccgtcacttctatggctggctaatcagctggcgcttgaatttcacgttccgtttcagacagtgcattctgaaaggcccgcagaaatcgtcattgatcttgatcctccgtcaaggaatgattttcctatggcagtggaggctgcgcatgtgctgaaacagctgtttgactcattcagcatgacgtcattcccgaaactctccggaaataaaggcattcagctctacatcccgctttcaccggaagcattcacctatgaagaaacccgtgcgttcacaatgctcatcgccgattattgcgtcaggacacacccggatctttttacgacagagcggtttatcaaaaaccgaaacggcaggctctacctagattatttgcagcatgccgaagggaaaaccattatcgccccctattcgactcggggcaacgaattgggaacggttgcggctcccctttattggagcgaagtcaactcctctttaacacctgatgattatacgatcgatacagtagtgaaccgcgtcaggacagagggagatccgttttatgatttttaccggaatccgcaggacggcccgctttcaatcgtgcttgagcaaatcaagagaaagagctgacgcttttggtcagctcttttcagtctgatacgtgcacatcaatttttctttggaaataaataaatagcaggagtaaggaatgtttttgagggtgagctgttttgcagtaaagtataaaatcggaagatgggccgctttcttaaacagcctgtagcagccgctggacggttttatcacatcaaaaccgagtctcgccgctcctttatgaagcattgtaatgccgacgactcccttaatctcgtctttccgtttatgctggttaatataatccgctaaatgtggcatggattgatataccttctgatatagcataatcccccttctgactgcgctttcaataggctgcagctctttcaggagtttgacattatgaagatgaatcttaactaacacgtcgttttttttaattctggttccgtcgctcaggatgacttcttttcctttatatctagtcaaacggacgcggaatacattcgattgccgtttatcaatcagcgtcagccgggtaaagaagaaataaagcggatcaagtaagtaccatatagacagcagacagcttctcacatgttcaccttctttatattcaaagcaccctcatattttggcatgaggcatgacacattatgattggtaaataatgatgcagccctgtatcagcttatgcaaaaaccgcttcaggctctactgtccgaaacagaaaaaaacactcttcatgaagaagagtgtctgtatccgctttcttttaacggaaaagcaaatgctggctgtgaattcctgcttttttcagtaaggctatcagctgttcctgttcctcaggcataagtcctgaaaacgctctcgcaattctcaatgaatgaatcggataaattttatccaaatactcgtttcctttatcagttaaatgggcgtaaacagaccgtttgtccttcgggtcttgttctctgaccaaaaacccgtttctttcaagcttgtcgatgacataggtgacattcccgctgacaagcaaaagacgcgacccgatttgctgaagcttttgcggtcctctcgtatagagcagctccaaaacggcaaattcagtcggattaaaaccgtgttctttactatcgcggatgctgtgttcagacacactcttgaaagcccttgcaaaaactttgtacaaattcatcgaacgcatcacttcttcttcgttaaatgataatctcatcatatctaccccgtatttaagatttttataaaaaaataatgtaaacccttacaattcataagagtcgttctttgttttatattctattcgtgccgtttttcagaattccttcttttttatataaaaaaatacccttatacatcatttaatttgtataagggttccgttctttatagggaatgttccgaaaaaaatacgcgtattcctttctcagctccgtaattgtcatggaattaagtatttctttcgtatagactccgatctgcagaagctttttggaataatggtttctctctttatccaatgcattttgaagcaaacgactcatgacggcctcctttgttttccgttattctatgatcagaataacgcttttatatcaaagatgtataaagccattgtaaaacttctgtagattatgatgtttttcggtaaagaccgttctggacggctctgagcagcggaaaagcgtgttccccggcaagctgcatgaacgcctccagcatttcatcgcgtttcatatctaattcaatgatttcttttgccagcgaaaccgctttttctttctccattcctatccttcctcctcattgtatctgtacaataagcataaaacgggggcacagaaccatgcattaaccttgtcaatttttctgccgctttttttctaaaattttctattccgcgtcagaaaacctgacaagcgtcaggttttttctctttttttcttatataatatgagtaaaagacatccaggggtggaaaaatgacgacagacgaacaatcttacaaagataaaaaagtaatctcgatcggcattgtaagcgaattaaccggattgtcagtcagacagatcagatactatgaagaacggaaattaatctacccgcagcgatcatcacggggaacgagaaagtattccttcgcggacgttgagcggctgatggatattgccaacaagcgggaagacggcgtgcagacggctgagattttaaaagacatgcggaaaaaagaacaggctctcaaaaacgacccgcagctccgcaaaaaaatgctggaaggacagcttaatgctcattttaagtataaaaaccgctgatcaaaaaagtccgcctcctgtgagacggactttttttataaagcatgaagaaatgcagttgcaatgccgaaataaattaataaggacaaaatatcgttcagcgtcgtaatcagcggtcctgacgcaatcgccgggtcaatgttcagtttatgaagaataatagggacgatcgttccggccatcgtaccgataatcaacgttgcaagcagcgatgaaccgacgacaaaaccgagcgttaagtctttctgccagacggttgcgacgatcgtaatcgcgatcgcacagacgatgccgatgtagataccggttcttaattcacggaaaatcagtttaaaaatggtttttttattcatttcttctttagccagtcctctgatgacgacggcgagtgactgtgtgcctgtattacccgtcgttcctgcgatcatcggcatgaaaaacgcgagggcgactactttttgcaatgtatcttcaaaataattcagaatgcttccggaaatcaatccgataaacaaaagcagaatgagccacggcaaacggcggtacgccgccacgtatgctttcgtatcaaatgtaatcgccttaccggaggctgcgaatttttcgtaatcttcatcggcttctttaatcacgacgtcaataatatcatcgacagtgacaataccgacaagcacattattttcttccacgatgggaatggctaaaaagtcataccgctggatcagccgggcgacttcttcctggtcttggagcaccccggccgagatgacacgcgtaaacatgagatcctgcactttatcgtcaggctcgccgagaattaaatctctgtaagagagcactccgacaagctgcttgctgtcattaatcacgtacaaataatttattgattctgcgatttctgcaaaacttttcagcttcacgaccgcatcttttactgtataatgctgcggaatccagacgaagcggttcgtcatcatcctgcccgccgattcttgcggatagttcatcaaaagctgtacggcctttgattcctcagcctccatactggataaaagctgttctttcagttcttcatccatctcttcaagcaatgcggcgagatcgtcgttatccattttattcattgcgagagtggctttcgttttaccgaccttatgcaaaacggcaagctgaaattcccgctccagctctccgatcatgtcggtgatgtcatcaaccgtcatatatgacagatagcgggcccggtgcttttccggcatttctttaaataaaaatgccatgtcatagggctgaagctcatctatcatgtttcggaattcttttatttttccgtcccgcaataaaatgataatgcgtaatatgagttcgtcataggtcatgttttggaccatcgggactcgtacctcctttacggagacgcgccgtccgtcaagggaagtgcggcggtttgtctcctcatcatgtcgtcactggttatctggctgtatatgggtacttcttctgacatactcgaatggggagaatccatactccgcacctccttatcatgctcagtcgtgtacgttttgaggcataaaaaaaaccttccgatatgaaggcgaaaacaagcacggcaaataaacgtgcggggcctccaatcgtagagctttagcactgtatggcataggacagccatccagctgcgttaagaatcaccttatgtcgatgattcctgttgacccattggcgtctttggacatttttgggcagcagcgtatctccatacaggagcctcacctaacgaagttcttatttgaattgacacactgagattacagaaaaaaaaggaatgtgtcaaccttaaatttgtgatttcagcacatgcctataaaataaacggaataaaggcataaagcccttattccggcaaatcgctttcatcctcttctgaaaggaaatgataggattcatgcagcatgagcgcgtattccccttcttttgtcgggtgcggtacatactcagcctcgttgatatactgctcttcccttttcttcatatgacagacctccttctcaattttagattgtccaaaagaagctccgttatcataggaaagaaaaaatcacttacggagagggacatgcagctatatttttcggatcgtaaaaaagttcctaagcagccacgggcccggtttgaaaccgagcgttaattgccacgcgccgatcgcctgcagtccgaactcccgaacgagaaccattttttcactcatgctccgtacatcctcaaaccacacttcatgcgttcttccattttcatcagtataccggaagtaaggggaacgctcctgctgggaataacggatcattgattgatgcttcatcgccgtttccatggcgcgctgattggagatggcagatccgatcgttccgggacggtacggaatcacccaatcatacccgtacagcggaacaccgagaatcacttttcttctcggcaccctgctgatggcaaaattgatcgtttgcctgacctctgtcaaaggcgccacgggtcccggctcactgccggcgtggtgccagtcgtacgccataatgaacatataatcgacgacggctccgattccgccgtaatcatatcccctcagccacggcactgcatcacttgttttcgccggaaccgatatcgttaacgcgagctgatgctctgaaagccgggtttttaactgccggagaaatcctgtgaagagatccctgtcagcttctctgacccgttcaaaatcgatatttacaccgccgtatccctttcttaccgttaaggagacgatattgttgacgagattcgttcttgccgccggattttgcagcacttgatgggctaattccggactgaatcccccttctgtcagattcgtaatgacggcaagcgggcgcactctgttctgccatgtggtttctattgcggttctgtcgtttaaatcgttcatgatatctccattcgggccgaaatgatattcaaacaaagaaatcgccgaagaatacggcgcaaaatcattaatcagctctctatccgcttcaggcgtccgaatgacataaaattgcagggttcccgcaagatagttagagatatcagggatcttcactttcatacccgtccgcagccggttcggcggaatatccgggtttgcctgcatcagctgcatctgcggcacataagccttacctgcgataacggcaaacgtatcattcggctgaaccgtatattcattaagagggattaaaagcgcctgccccggaacgatattcgtttcctcaagcccgttgacgcttctgatgctgtcaacagggtatccgtactttctgctgatggaaaataacgagtcgccagactgcactgtatgaacaaacatagatgtcctccgtttccttttgatcaaaagggctcttcttatctttatgaatgatcttccggtccgattccaaactctgttcggagaaaggctgtttacaaatcagacatgatcaactatgatgatgtcatcataaaaaactgtataggaaacgcactaggggtgctgttatcggctgagataaaacatgcggcaggcgtgttttgatcccttataacccgatctggataataccagcgtggggaagtgcagattgaccggagcgcagggtttttccccatgcgttttcgttctgctgctgcatattccctcggatatgcagttttttatttttcattaaaaaacgggggaggacaccgcaatatgaaacttacgatcaatcgtctttcgtaaaatcaactctttcatacttacgactatcgataagaaagcaggagatcacaatgaaaaattggaaaatgagagaaattgtcgtcatgtccgtcatcagtgttgtatttgctgtcatttatttagtatcaactcatgcaagcaatatagcggcaggatttttcggccggatgagctacgaaccgatttacggtatctggtttatcgtctcggtgattgccgcgtacattattcaaaaaccgggagcggctctcgtttctgaaatcatcgccgcgtttgtggagtgcttactcggaaatccgtcaggaccgatggtgattctgatcgggatcgcacagggaatcggtgcggaagcaatctttttagcgacacgctggcgggtatataccctgcccgtgcttcttttatccggtatggggtcttctgtgacaagcttcatttatgacttgttcgtttccggatactctgttttgaatccgggtttattagccgtcatgcttctcatccgtctggtctcaggtgcgcttcttgccggccttctcggcaaagcaatcagtgatgcgctggcttacacaggagtgctgaacggcatggcgctcggaaaacaattcaagaagaaaaagaaacaggtgaaccaagatgcaggcatctgaaccccttctatccgccggccgtcttaccttttcttatgatcaggatgaaaagccgatttttcaaaacgtgtcctttcagctccgcaaaggagagcgggctttgttgctcgggccgagcggatgcggcaaaagctcgctcgctctctgtttaaacggtctgtacccggaagcatgcgatggggttcaatcgggaaccgtttctttatacggaacacctctttcacatctgacagaacccgccgccagatccatcggcgtcgtgtttcaagatccggaccagcagttttgcatgctgacggttgaagatgaaatcgccttcggcctggaaaatttgcaatatacaaaagaagatatggacgcaatcatcgatgacgttttagaaaaattagagatcactcatctgaaaacgcgaacgatcgcttcgctgtcaggcggttcaaaacaaaaagtggcgcttgcctgtatcattgcaatggaaccggaactcattattttggacgaaccgacggcacagcttgatccatattcggcacgtgaattagtgcggctgatcaaagatcttcaagcaaaaaaaggcttcggccttctcgttatcgaacatcagcttgatcactgggcgccgtggatggacaggacgattgtccttgacgaaacgggtcagaaggtgatggacggagagacagatgttatctttgaaacaaagattgaagagctgatgcagctcggcattccgattccgcgtgtgatctcattgcaggagcacgtcagcattccttttacattgtgtaaagaaaatctgtttgacgaacctgtaccatctctgcccgaaccccggcccgccgcgctttcggcagaagacgcgctgagcgttcacgaactgtcattctcaagaggagcagaagtcatttttcaggatgtgagcttttccgtaaaaaaagggtcaatcaccgcgattgccggtcctaacggaacaggaaaatccacgctcctttctgccgcggccaagctcatccgtccgctgggcggagacatcaaaatagacggcagaccgattgattcctattctgaaaaagagctgcggcgacagatcggatatgttttccagaatcctgaacaccagtttgtcacagattccgtcattcaagagctgatgttcggttttgaaagcaacagagccgcaaaggagaaagctcttcagctgttaacccgattcggcttgagacgccatgcctcacagcatccgttttctttaagccaaggacaaaaacgcaggctcagcgtcgcgacgatgcttatgcacaatgtgaacgttttgatgcttgatgaaccgactttcggacaggatgccaaaacggcgcgggagtgtatgcaaatgctccgtgagattcaaaaggaaggaacggctgttttgatggtgacacacgatatggaactcgtctcggattatgccgacacgatccttgtgctctgcggcacgaagctggtgtaccgcggaacgcccgactcattgttttctgatcatatcggaatcgcggagcgggcgcatttagctttgcccctgcggtatgaatggatgaaacacgacaggaggcggagaaatgaacttgcggctggaggctgttaacccgtcaataaaggcggcggctgtattgttatgcgtcattatgctgtcatttatttataatccgtacacccctgctttgttttatatcatcattgcgggaggcgtcctctcggcggggcgtgtgccgctgaaaaaatggctgctgttcacgattccgtttgtcattctggccttcggttctttatggacagccgccgtattcggaaacgtcccgacaaccgggagcaatctgctgtttaaactcgggccgattgccgtcaacagtgataacgcggcgctcgggatttctatcgcgtttcgtattttatgtttttccgctttgtcgatgatgtttctttttacaaccgatccgattctgttcatgctcagtctgattcagcagtgtaagctgccgcccaagcttgcatacggcgttatcgcgggattccggtttctccctcttctgaaagatgaaatcctgatcatccggcaggcgcacagaatcaggggtgcggcgtctgattccgggctgaaaggaaagctctccgccttcaggcgcttcaccattccgctattggcaggcgcaatcagaaaggcggaacgcacggcgatcgcgatggaatctaaaggctttactgggagccgaaaccgcacgttttacagaactgttactgtgcgccgcggcgactggtgctttttcctgctcgtgcttctgttattcggcgcaagctggctcatttcattgttgtttgtataaaaacaggccgccggagtgattcggcagcctgttttgttatgtatgttattgatgataattgagagcctgagcgagattggacttgaccgtaatctctgagaaattaatgccgagctgtacggcggtttgagcaatttccggcctgattccggataaagtggacgtgacgccgatcaatttcagcgcctcaattaatttaaaaatctgatgcgccaccatcgtatcgacaaccactacacccgacaggtcaattaacagatgttcaatcagccgttttgcacatgtgctcagcgtattttcaagaatgaatttggcgcgctccgtgtcaatatcgccgacaagcggcagcagcgccgtccgtttgctcagcgtgataaccggcgagcttaactccaaaatcatttctctttgcgcattcagctgcatttttgagttatgctcagcatgatcgacaaacgtgtaaatcgtaaaatcaaatacttgtgcaattaaattctcccatttcttcctttctccctcggcaaatgaagattcatgtttatcggcaaacgcatcataataactgatgtatagtctccggtttctcatgaattcacggactacatactggacgggagtatccagatgcttctggtctttcgcaagctcaatcacccaccgctcgaactcttctaaaaattctttttccggcatgatatacattttattaatatgccggtaaaattctttatcctgctccgtcagttcttctgtgatgacgggatttgtcaaagaataaatcgaattcggatccgaatcttccatcgtttcgatccactctttcgcaatttgatccacttgttctgaaaaatagctgtataacgcttcatttatcttcatctctcttctcctttcccatttccaattatagcctcagagggtcatgaatgaaaatgaaagctgtcaaactatccatttatttgaaattttttagtccgatagattacgccttttttatgaaaatgcttcaaatgactctttccggccggcatgctctgccataaaatagtagcaacacccttgtatccactcgcaagcataaaaaaggagggcttttttatgaatggtgaaatgcatttgattccttatgtcacggatgaacagatcatggatgtgaacgagcttcctgaggggattaaagtgattaaggcgccagagttgtgggcaaaagggtttaaaggcaaggatattaaaatcgcggtgcttgacacaggctgcgacatcaatcatcctgatttgaaagaccggattgtcggcgggaaaaacttcaccgatgatgacggaggcaaagaagacgtgatttccgattacaacggacacgggacacacgtttccggaacgattgcagccaatgattcaaacggcggaatttcgggtgtcgcgccggaagcaagccttttaatcgttaaagttctcggcgggaaaaacggcagcggcaaatacgaatggatcattaacggcatcaactacgccgttgaacaaaaggcggacattatttccatgtcactcggcgggccaagcgatgtgcctgaactgaaagaagcggtcacaaatgcggtaaaaagcggtgttctggtcgtttgcgcggcaggaaacgaaggcgacggagacgagcgtacagaggaactgtcgtatccggccgcttacaacgaagtgatcgcagtcggatcagtctcaatcgcccgtaaatcgtctgaattttcaaacgctaataaagagattgacctggtggctccgggagaaaatattctctccacccttcccaaccataaatacgggaagctgacgggcacttcaatggccgccccgcatgtgagcggagcgcttgccttaataaaagggcttgaacaggacgcgtttcagcggacgctttctgaggctgaagtctacgcccagctcgtgcggcggacccttcctttggacatcgccaaaacattggccgggaacggatttctgtatttagacgcgcctgaagtgctgatggaaagagccgaacaggcacagctgctgtctttctgatatttttctcgtataatgattgatcagtttgtcacatcaccaatttttaaattgtgagattttctattgacagtgatctgaataagctgataagataaccaacaaatgatgtaacttttcaaaaaaattgaaatactttctcttatcgagagttgggcgagggattggccttttgaccccaacagcaaccgaccgtaattccattgtgaaatggggcgcgtgatttttgcgccgagacgattgtctcataaggcacggtgctaattccatcagacgtgatctgagagataagagaggcttgcattttgaagttaaagcctctttctctcatgagaaagaggcttttttgttacatctcacttaaaggaggagacttaatgacaacaatcaaaacttcgaacctcggttttccgagaatcggcttgaacagagaatggaaaaaagcacttgaggcttattggaaaggaaacactgataaagaaacgtttcttaaagagcttgacggcttattcttatcagctgtcaaaacacagcttgaccaacatatcgatatcgtgccggtctctgatttcactcattatgatcatgtgcttgataccgccgtcagctttaactggattccggaaagattccgcagcatcacggatcccgttgatacatactttgcgattgcccgcggtgtaaaagacgccgtttccagtgaaatgacaaaatggtttaataccaactatcattacatcgttcctgaatatgatgaaagcattgaattccgtctgacgagaaacaaacagcttgacgactaccgccggatcaaagaagaattcggagcggaaacgaaacctgtcatcgtcggtccgtatacattcgtcacgcttgcgaaaggatacgaagaatcagaagcgaaagcgattcaaaaacgccttgttcctctttatgtgcagctgctgaaagagcttgaagcagaaggcgtcaaatgggttcagattgatgagcctgcccttgtgacagcttcttctgaagatgtccgcgccgcaaaagacctctatgaatctattacaaaagagctttcaggactgaatgtcctcctgcagacatactttgattcagttgatgcatatgaagaactcgtttcttatcccgtacagggaatcggacttgatttcgtgcatgataaaggcagaaaccttgagcaattgaaaaagcacggcttcccgaaagataaagtgctggcagccggtgtggtcgacggccggaacatttggaaaatcgatgtagaagaacgccttgatgcggctttggatatcctcagccacgctgatgttgaggaattatggattcagccttcaagcagccttctgcacgtgccggtggcgaaacaccctgacgagcatcttgaaaaggatttgctgaacggcctgtcatacgctaaagaaaaactggcggaactcggcgtcttaaaagaagggcttctgtccggcaaagcggccgtcagtgagcagatcgaagaatcaaaagcggcacttaaggctttaaaagcattcgcaaccggagcgaactccgctcaaaaagaagagctgaatcagctgacggaaaaagatttctcccgtccggcaagctttgaagaacgattggcgctgcagaatgaatcactcggtcttccccttctgccgacgacgacaatcggaagcttccctcaatctgccgaggtgcggagcgcacggcaaaaatggcggaaaaaagattggacggatgaacagtaccaagcctttattaatgcggaaacgaagcgctgggttgacattcaggaagaaatcggcttagacgtgctcgttcacggagaatttgagcggacggacatggtggaatacttcggtgaaaagctggccggattcgcctttacgaaatatgcatgggtccagtcttacggttcacgctgcgtacgtccgcctgtcattttcggagatgtcgaatttatcgaaccgatgacggtaaaagatacggtctacgcccaatcgctgaccgaaaaacatatgaaaggcatgctgacgggacctgtcaccatcttaaactggtcattcccgcgtgtggatatttcaagaaaagaaatcgccttccagatcgggcttgccctcagaaaagaagtaaaagcgcttgaagatgccggtattcagattatccaagtggatgaacccgcgctccgcgaaggactgccgttaaaaacgcaggattgggatgaatatttaacttgggccgcagaagcattccggttaacgacgtcttctgtgcaaaatgagacgcagattcatacgcatatgtgttacagcaactttgaagatatcgtagatacgatcaatgatcttgacgcggatgtcattacaatcgaacacagcagaagccacggaggatttttagagtacctgaaagaacatccttacgtgaaaggcctcggactcggtgtatacgacattcacagcccgcgtgtgccggcaactgaagaaatctatcaaattattgatgacgcgcttgaggtgtgtccgactgaccgcttctgggtaaacccggactgcggactgaaaacaagacagcaggaagaaaccgttgcggcattaaaaaatatggtcgacgccgcgaaacaggcacgaaaaaaacaagctcagcttgtataatgaaaacagccatccgtaaattgcgggtggctgttttttctgggcgtgctacttattctgcagcgcttctgccagttcatacaatgaatcatactgcttaatttgatagccccgcccctctttttgcaaataccctttttggcagaattgcgtcagcacatgcaagagatgacggtaagatacacccaaataatcacagaccgttacgtgcttctctttataaacccctttataagccgtctgcaaaataaaatcagcaagccggttttcaagcgggaacgccagactttgtgaatatttcgaagccataagcgttgccttagcacttaaaaacttagccagctcacgcaggaatttcgcatcctgcagcaattgcgcgcggcagcggtaaataggcagaacaaaacaaacagtcttcgctgaggcttgaattccttttgtgtaatacacttcatgtaatagttccatctctccgatgtaatcatttttgttgataaaattaattaaagaaactttcccgttttggtgggttacatatattttcgcttttccttcaatcacgtaaaacaggaagtcaggcctcctgccctcttgaataatccattcgtcccgctcatattcgcgcacttccataaactcttcagcggggaaagagaataaatgcgcgattgagtgtttttttaactgatgccgctttttctcgcctttataaatttccatcgtccaccccaaaaatatgagatatctcatattgtctttatgtccttacatgataacatgccaatgaaaggaggaacgggaatgaaagcatatcgctggatgagtctgcattttttttgtttttttatgacatggggtgtttttctgccctattggacgggatggatggtgcatataaaaggggtttccgtatccgaagccagtttcattatgagtctgggcctggcggcaagagggatttccacattatttttcttcccttatttatcaggaaaattcagcagcaaagccttattaaacggtgccagaatcgggacgcttctcgcacttttatgttatattcccgctgattcttttcaaagcctgcttcttgtcacattagtgctgcatgtgttttacccggctttaatgcctgctttagacagcgcttgcggcgtccttgtacagcataacgaattaaaggcttatgggactagccgacagtggggatctgcgggttttgtttcagccggcgtcatcctgtccgtctttacaggtatattcggagatcaagcgattttatgggcactgcttttgagcgccctgatattcgcatccctaagctttatgcatgcgccagctgttctttcaaaacggccggaaacagaccgcgcaagaaaagagggcatgtttgccttattccgcatcaaatatttcggtctggtgctcgcaatcgttatcttactgcaggcggcacatgcatcttactacaattacggttatctctttttgcaggaaatcgatgcgcccgcatatgccatcggaatcatcatcaacatcgccgttatcgcggagattatcttctttgcaatcgctgaccgatactttcatcaatttacggcaggctctttgctcgccctggcggcgcttggtgctaccgtacgctggatactcgtatttgcctttccgcatgtcatcattttctgtcttgcgcagacgctgcatgcctgttcattcgcgatgggacactatgcatttatgaaatacttaattaaaaatatttcacccgcgcaaatcccgaaagcccaaggtatatattcagcgcttgctctcagctggagcactgcggtatttactattttcggaggttttttatatgaaattgaaccccggtatgcctttatcggaatgattgtttgtacgataccgtccatgcttctcgcccttttatacagaaaacttgaaatgaaaaagagcgtttttgcaggaaacgcacaagatatatagccatcgctttatagacgatcacatgtcccgctgtcattttgaccgattttgtgaatgctgtgcgatgtattttctctatatttaaagtatttccttcatatatgatgaaattaatgaagggaattcgttcagaaacttggacagaatcagtgaatataatgatacagtactgcttacgctcatttgggggaactttgttcgcaataaaatgattttcagccaactcataaggagggacattgtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgactggtgccacggggccgacgggggtcacgggtgcgggtcttcaagggattgttgcttttaatccgctgatcgcccctacttacacgaccggacaggttgtcttgtataacggcagctcttatgtcgcaaacgtaaacagcccgtcgggaacccctgaaacctcagctgactatacacttttagctgcggcgggaagcaccggcgctactggttcaaccggaccgaccggaattaccggggctactggcggcactggatcaactggaattactggcgttacaggaccgaccggagttaccggggctaccggcattacagggcctccgggaagcaccggaacaagtctgacagccacttccggctatgcgagcaatacgggcggcggtgttgtcgcagttattgtcggcggcacggacatttccttaccgaatgaacaaaacctctcagcggatattaccgctaatgccgcaaatactgtattcaccgttgctccggcaggacggtactatatttcctaccatattaatttaacggccggcctgctagtaagttcgcgcatcttaatcaacggcactccggctgcaagttcgattattgccccggtcgcgtctttggcaagcttcaataactcctttattgtgactttgacagcaggcagcaccattcagctccagctgttcggattattgggtgcggccacattgcttagaggaagtgccggcgcagctttaaacattattcgattatcttaatggaacatgcaaaaaaaggatcaggcgtttgtccgctgatccttttttaattgagacagaagttcttgcgcgggtttaaattgcggattgaatttcacggattttttggcgtaagcgatggccgtcatatcatggtttaatgcagcatggcatttcgccatataataaaaagctctgaaatcggcggcaccttttaaaatgaagtgatcagcgttttctccttcaacctgcgttccggcttcaaatgctttgattgccgctctgtacttttccaaatgatataatacaaggcctttataataatgaagattgctgtaatcaggataaagcttgagcactttttgaatcccttgttcggcttcttcatatcgcttgagctcaagcaatattgtatattttagaaaatacagaagagacggaggcattcgtttctcacttaaaaattgaaatattgagccgttgacaagatgtaatgctttttcatagtcttttattctgtaacattcacttgccagatgatagactagccacggatcaggattttcctctgaaagttcttcatttaatatgctgatattccgtttatgtttttgtttgattttttcttcctgctccaagtagccgtagtgatgaatcacacatgggagcgtgaaaaaagcattgttttcttcctcattgggagccgagatattctcgtgaattctgccttgatacagaaggcctttatgattgcggaacagcctcggctgcatgctttcaaacgcttcgttttcatcgagctgcttccccgtataattgatgattttcaaaagtccccggctcggtaatccgtcatgaagcagagaagttaaaaaacggcccgtctcctgatcgagctcttcatccgcgtcaagcactaaaatccaatccccttcggcatgctgcagggcgtaatttctggcctttgcgaaatcattctcccattcgaaatcaaacactcttgcctgaaagcttttacatatatcttttgtattatcttgtgatccggtgtctgcgatgacgatctcatcagcgatgtcttgtacacttgataaacaacgggagatatatctctcctcgtttttcacaatcatgcaaagagtcagtttacattcagcatttccgctcattttctcacctttcccgattttggagttgttgattgaaccaaggccgtccaggagtgccgttcatcgttatgatgacaggccgcacccatctgacggcaggttcggcagttgattctgcatcccattcctgaagctgcctgacagcccgcttcgtaatgggatgcgcccggaattcgcgcgggctttcacaaatgaattttttcgttcgttccgtcactgtcttcatttcatgaaagtgccgcgcatacatctgcttctgttcttcttccaagctgatcattaaaaacagccggccgcctgtttccatctgccagcggcacaatgcggagaacagcctgatttcttctttgtaatttgaaccccttcttttatccacggtcacagataatatatttaacagcgccatcgtgagacaatgcaaggcttcaaaagatgtctgtttcgcttttgagatgctcggatacggcatatgcttcacccgtctctttttttatgaacgctccccgccttttttcttccaatcgcagtcctcacaatccccgcactcacagcagccaatacggccgtaaaacaggtcgtcacacggatcttccggatcactgggatcgtccggattccacgggtcatcaggatcgcccggatcactcggattacttgggtcgtccggattccacgggtcatcaggatcaccgggatcactcggattacttgggtcgtccggattccacgggtcatcaggatcgcctggatcactcggattacttggatcgtccgggtctatacaggcttcagcatcctgtaagtagataatgtcttcaagcttcgtctgcaaaaggagttgtgatttcatgacggtgcgcaggagccgttcagtgcttctattgattgatgataattcccctaaggagggatcgccggaagcgctgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagacatcgatttctccctcttttctcttggtgtcattatgcaaaagtgctatatcgtattcttattccgggagagaagagatcattactgatgttttcgttaataaaatatcccggatatgaaatccgggatattcgttcgtttctttatttcaattcaagtttgacgtctacatttcctcttgttgcttttgaatacggacagaactcgtgagcggcgtgcaccagcttctccgccgtttctttatcaagatcttttgtatcaatgacgagcgttacgccgattttgtaacccccgtcactctcatcttttaaaaggctgacctgtccttcaatttcagaggtcatgtcgattttttgtttttgggcggcgagttcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattgcaataggaaatgggccgtttttcggctacaatagggataacgttaacaaaaaagagttggtgaaagaagtaatggcagaaaaagattttgaacatatgaaactggagaatcagctttgttttttgctgtacgcaagctcaagggaaatgacgaaacggtacaaaccgctgcttgataagctcaacgtaacttatccccagtatttggcgctgcttttattatgggagcacgaagaactgaatgtgaaacggatgggtgagcttttgcacctggattccggaacgctgacaccgatgctgaaacggatggagcagcacggaatcatcatgagaaagcggtcggctgaagacgagcgatccgtgacgatcaggctcacagatgaaggacgggccttgcagaatacagcggcggatatccccattgccatgctggaacagacgggactgtcaaaagaggaattaaagcaggtaaaacagtcgctttatgaggttttgaaaacgctgcacagcaaaaaataaggatgccccgaatgggcatccttatttttattctgctgccagaagcttcacttcaatatttcccgctgtcgcttttgaatacgggcacacaccgtgcgctttttggataagggcttcaagctcctgtttctcaatgccggatgctttgacctcaagggtaacgccgagtttatatccttggtctctttcatctttcagcagactgacatgcgcagtgacctctgtttcaatactcagacgctcttttcttgctacgagttgaagagcgctgtcaaagcaggctgaatatcctgcggcaaacagctgttcagggtttgtggcttgttcgagcttttttgctcttggcgttcccggcatggcaacatcaagattcagcaccccgtcagaagacgtgactttcccttcacgtccgccgtcggctgatacggttgcagtaaataatggttttgtcatgtaaattcacctctattatattgtgcacaatttaattttacgaaatataatggaaaccgtcaatctttccgcataaaaaaagcttaccctttttgaaggataagcttaaaagattatacccggatttgtccgtttcctttgatgatgatttttgtagatgttaacgccggaagtcccatcggccctctcgcgtgaagcttttgcgtgctgatgccgatctcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgtttttacactgagaatcggcgccaggtactccgctccccaatcggcttcttctgcttgtttcgcttgaggctccagtccgcaaatcacctggtctcctcggagctccacccctttttctgtcagctgattcagcagctttcgtccgtgttcttcggcccatttttcatgaatcagaagagattcaatcgcgttgcagaccgaaggacgctgtgttttggcgttgatgacgacctcgcttgccataaggggatctgctgactcatctatgtacacgtggcaattgcccgctccggtttctaaaacggggacggttgattccctgaccacaagatcaattaaatttttaccgccgcgcgggatcaatacatccagcccgtcatttaatgtaaagagctgtttggcggtttctttgcttgtatcttcgatgagctgaacggcatcaatcggaagctttgacagcccaagtgcgcgtttcatcacactgacaagcgctatgttgctgtggatggcggaagaacttcctctgagcacaaccgcgtttccggttttcagacagagtgtggccgcgtctacggtaacgttcggtctggcctcatagatcatgcccactactccgaggggcacgcggatcttttcaattgataatccattctcttttttaatggtctccaatgattcaccgacgggatcttcaagaccgattagcagttccacggcgtccgcgatatcgagcaggcgtttttcatcaagcgtcagcctgtcaataatgtcagctgtcagtcctctgttccgtcccgcttcaatatctttctgattctctgttaaaataagccggcgttcatttctgagtccgtctgcaatacattggagcgcttcatttttttcagccgtcgttttcatgaccattttggcagccgcttcttttgccaaagccgctttttgcaatacttcactcatttgtgttccccctcgtcaaataaattcacccaatcatctctgtgaatcacttccacctgcttcgttcctgaaagctggtcgctccgcttccctttggcttctaaaatttcatcggaagagtactgcgtctgccctttgccgataatgccgccgggccctctgacttccactacggctcctttcggaaaactgccgcagacatcggcgacgccggccgggaggagacttgacccgttatggatcatcgcctgctccgctcccccatcaatgatgatttcccctgatatcggagaatgaaacatgatccattgccgtgtattattcactgaggacaggtctttatcgccgatataagtgccgtcgccttttccgtttaaaatcacaatcagtttttcacgtccggagccggttccgataaacaccttcaccccgagcgacaatgcggtctgagcggcgagaagttttgacttcatgcctccggtaccgacctttgagcctgctgacccggcatatccgagcaattcaggtgtgatgtcattcagatagtcaaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagctcttcgactgatgtggaatcattctcattaataatcggcacgacgccgcgctccaacagttccattacagtggcataggcatttctgtaccgctctctttttgagaaatcatttcttgttaataaaatttgtgccggcgtcagaccgtatctttttaaatggtccatatattgctgcattaaaagcgtctggccgactgcggcagctgcctgttttccttttatcgtaacgggtcgcgacggatagccgagagcggaaaaacccgctgccaccgcgcctgaggtaatgaggatcacttcatgcccgttctcttttaataaagaaatggcttccgtatgttccttaatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacgcgtcccgctttcctgtaacgccaggtatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagcccgcctccccggcggaccgtcattaattaaatacgatcgttttgtttccgtgaacgatgacgcggtcttccagatgccattttacggctcttgccaacacgctccgctcaatcgttctgccgatattcttcagatcctctgcgtgatctctgtgatcgacgcgttcaatatcctgttcaataatcggcccttcgtcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttatactgctccagcagctcaagctggcgccgctcaacttcggcgcggatatctttgttagctttcatgtaatggaatggaatattcagcggctcgaccacttctttcgcctcttcatggttgctgatgacgaccgcaatttcggccatcatattgccgctttgccattcccaaatcagttcatgaaggcagtgcagctctttggatacaaagatcgccactcgcttcagctcacttgccagagagaggctccatgtcatgccgaatgtctgggcgattgaggcgaacgcctgctgtaaatcctcttttttctcacgaatgcccttgcagtcgaattcaatcctgagaaaaaaacgtccgccttcagggtcagtcgtatattgatttgattcaataatatttgcgccgtgttcaaacaaaaacgcggaaacagccgatacaattcccggctgatcggggcagctgacaagcaggcgccctttttcctcattaccgcggcggtattctttcagccgctgtgtcatatatgaattcatctgttttaatccctcgtatcttcataattcgtaacttattatagattatactgaaaatttgataaaaatcaatttacgaaagaattttcagccctacggctgcgcacaaaataagcgcaatgaaaaagatgcgcttcgcatccttctgctcgccgtagaaaagaatgccggctaaagcgccgcccgccgtgccgataccggtccagatcgcataggccgtgcccatcgcaatcgtctccatcgcataagaaagcagggaaaaagaagccgcaaagccaacgattatgaagagaatccacttgactttcttttctttttgaaattgattcattaaaatgaccccgagcatttcacaaagacccgcggctatcagactgatccaatgcattacgccttctcctccttcgtctcaggcttatcctgtgtgaccagctttaatccgatgacaccgatcagcaaaacgccgatcagcacgatttttaccggatcggcctgttctttgaaaagcaggatttcactgagcacggtgcccgctgtcccgagtccggtaaagaccgcatataccgttcctacgggcaggctgtccgtcgccttgattaatagataaaaactgatgatgattcccgtaatcgtgccgccccacgtcagtgccgaatcagcatgtttcaggccggtgacccataccacttcaaatacggccgctatgaccactaaaccccatttcatgttcttcatcctttctgtttccgggcaatacaaaaagcccggaatagtcgtctcacatgagattgactctcccgggcttttttccctccgtgtgcatatgcgggatatgtccgcatatgtgttttctctcggaccaggccatgtatgaacatgcggaaccctagaaaacatgtctgttcgtatcatactacatttcgccgaaacgttcaatgtcagatgtgatgtcaaataccgtcagccgcctctcccatttggtaacggtctcaccgggcaccatgccgattttttccgcgacgcggacggaggcagcattttccggatcaatcagcgccgctatgcgtccgtattgctgcgtatgaaaaccgtagtccagacaggcgttcgccgcctctgtcgcatagccgcagccccagcggcagcgggcaaacatatagccgatttccatcaaagtgtttccgcttatcgtctgcggaacgattccgcattgaccgagaaatgcacccgacactttatcctctgcgatccaaagactgacgccgtatcctgcggccaatcgtttgttccaggcaatccattccttcgtttcccgtctgcttttaagagaaggataatatttcatgacctctctgtcggtaaacagcccgtacaaattgtcttcatcgtcatcccgcatagtccgcagacggatacgcccggttgtcaggatggtgccggaagacttatgtttcatcatgcacgccacgtctcctttccctgtaatagattatggatccggcaggaaaagtcctttttcagcataaaaaaaccgcttttaaaaaaagcggtttgacgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggcaccgatttcccgtttgaatcgagcgcgacgaatgtcagaaacgacgttgccgcaagctcgcgttcacccgtcatcagatgttctttaatgactttgacaaacacctccatagacgatgtgccgacccatgtgacgtaggattcaagacatacggaatcctgttggccgatcgggcgcaaaaaatccacagaatccattgaggccgtgactgtttcacaccggcagtggcgggccgcggaaattgaagcgatatcatcaatatagctcatcagctttccgccaaacagcgtattgtgattattcgtatcaagcggaaaaaccctgcttgtcttgacaacccttgtttctttgcaaaatcttgattctggcaacttcatattatttaaactcccctttggtgtctggtcgttttgacatttcatctgtaccctattaaacaatactttgatcgttttgtctaaaattttaaatattaagttggttagatattctatcaggtatgtttcattattcagcacatccgggaataataaacgcacattgaataccgataggaggatatcacatggacgtatccattcccaaatccacgcggaaaccggcttgccgcagtgagtttgatgctttgcagacagtcatcttatgccggccggaacacatgaccatcaaggatattattaacggaacgcagaaacatttcaaacaagaaaatattaacatacccgttgccctcaaacagcatagtgagtttattgacattttaagatctcatcagattgaagtcgtcctgctgcctgccgatcccgctttgcctgagcaggtattcacccgggatatcggatttgtcttaggcgagacagcgtttatttcaaacatggcggcttcagtccggcagggagaagaaaaagtgtttcaagacctgcttgacgataagaaaatcccttatacgcgactgaaaaaagcgaacattgaaggcggcgacatcttgatcgcagacggcaccgtttacgccgggctgagcaagcgtacggataaagcggctgtccgggagctgcgggaggcgctgccggagatgactgttgtgccgatccctctcaaggaggatttcttacatttggactgtgtatttaatatgatctcggaaacggaagcgctatactgtaaaaatggcttgcggcagaaagaaattgatcttctcgccgaacgttttgagatgatagaagtgcctgaagaagagcaattcacgctcggcccgaatatcctgtcaatcggcaatcagacaattatcagcctgccgcagcaccgtcatacgaaccgcgagctcagaaaaaggggttatacggtcattgaaaccgagttttccgaaattatcaaatcaggcggttccttccgctgctgcaccttgccgcttgtcagaacatcttaaacatttacaaggcagtttccttcaagatacgttaatatagagaagacaagactctaaagggggaaaccgaatggctaagtacataggatacgcgggaacatatacaaaaggcggaagcgaaggcatttattgttttgaacttgatacagaagcgaaaaggctcagccggccgaagctggcagcaaagctcggcaacccgacatacgtcactccgaattctgataacagcatgctgtattccattgaaaaagcagacggaaaaggcggcgtcgcagcctatcagattcatcagaacagcggggaattaacgtttgtaaaccaccagctgattgaaggcccgtctccatgccacgtcagcattgatgataaacatgaatatgtgttaaccgctaattaccacagcggaaaagtgcacgcctttcccgtcaatgaggacggaagtctgcaggagccggctgccgaagccgctcatacgggaacaggtcctcatgaaagacaagagaaaccgcatacccatttcgctggctatacacctgagcataactacattgcagccgtcgatttagggacggatacgctgtatacgtaccaaatgaaaaacggttcgctcacagaggtgaaaactcactctttcgcaccgggttcagggccgcgccacatcgttttccatccggcggaaaaatacgcctatgtcatgacggaaatcagcaatgaagtcatcgcgcttgaatacaacccgaccttaggtgaattcagagagctgcaggtcatttccgctttgcctgaaggctttacggacaaatcgcaaggcagcgcaatccgcatatctaaagacggcagatttctttatgccgccaaccgcggacatgacagcatcgtcatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgtgatccggaaacaggcaaattgactctgcttcaatctgacattccggttccgtatccggtctgcgtgtcatttctgcatcaggtttaatcaaaaagaaagctgactttatattgtcagctttcttttttgtataaatggcaggcgacaaaacgccccgccttcacttcttcaagctcaggcgttatcttaccgcagagctccatcgcttcagggcaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaataggttgacgacctgagcctgtaccgacacatccagcgcggaaatcggctcatccgccacgataaattcgggatgcagagagagcgctctggcaatcccgattctctgcctctgtccgccgctgaattcgtggggataacggctgccgaaatccggatggagcccgacagcttcaagcagttcatccgccatcatcatacgggcttttcttgtattgtaaagattgtggatttccatcggctccataataatttcccttacggtcaggcgcggatttaacgaggcgtaagggtcttggaaaatcatctgcagcttgcggaagaagaccgaccgctgttcggccgcggcacggtgtatatccgtcccttcatatgataccgaaccggccgtcgggtcatacagacggagaataactcttccgagcgtcgatttaccgcatcccgattctccgacaagtccgaatgtttcccctcttttaatgtgaaagctgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagatcgttccttccaaggacagcacttcgattgtttttcccgttttcggggagtgcagcattcgtccgtctcccagcgccaaaccgacatggtgaatcgcgccttttccttcttcataggcgaaaaacaaaaggtcagccggccggatatcgtttaccgccgcgccgcacccggcttttgcttggtcctttgcatcacggggaagggtatagccgtttgctttaaatatcgaatacataaacccggaacagtcaaacccgaaaccgctcagtcctccccataaatacggaagcccgagaaacatcatgcccgtttcgatgacctcggccgcccgtccttccgtatgccggcactcgtctgcgtcagcttcatttacgaaccgttctccgagaggcgtcacaacccgaaaaaagcctttctcacgtcctgatgccggaagacgcgttaagaaacttacttccaagtccggttcgccgttagtgtgatataaaaaagctgtcggtttggtaatccatacggcgggcgaagatgaaaaaaagccgtcttttgaaagctggctttttttcatccagcccggatatccgcgcgcatccttgtttgagggctggccgggaacggcgacaaaagcccattccccttcctctttgagaatgatcacctcttccccgaaaagcgcttgcgtttggacaaggttgtctgtgcataattgcagccgctcttcatatcccatagacgctaaccattttctgatctgcggcgggttttcaagcatcggcgcatcatacgaacggggagatgacggcatcgtccatacgttggctgccgccgctgtaacggctgctctcatcttttcgcctcctcttgtttcgacaccccggtaatgccgagacccggttcatcgggaatcgtaatctgactgccgctgtatgtgatgccgcctttaatcaaatcatctttcagcataagcggcgcatcaaaatcaaaccttgtcacattccgtttgcccgcggcaaaatgagccgcggcggtgatgccgagcttggtctcaatcatgctgccgaccatgcattccacgccgcacgtttcggccatcgcattgattgtttccgcctgctttatgccgcccgctttcatcagcttaatattgattaaatcggcgcttctcgtctgcagcacgcaaaaggcctgacggggagtaaagacgctctcatccgccataatcggcgtgtctacggcatcggtgacctgcttcagcccggcgatatcgtctttatgaacaggctgctcgaccagctcaatgccgaggccggcgtcttccatctttcggatcgcagtcacggcttctttcggcgtccagccttggttggcgtccaatctcagtttgacgtttccgccgacacgtgatctgatcgcctgaatccgggcaacatcgtccgatatgtcacctatgccgacttttatctttaaaatatgaaatcctttgttcacatagcggtctgcatcccccgccatctcctcaggagaattgacgctgacggtaaaatctgtttccagtgtattccgatagcctccgagaagccggtaaagcggctgtccgtgcatttgcgcccatccgtcatatacagccatatccaccgcggcttttgcgctttgatttctttccaacagccggctgatatcatacaaaacagcttctatgccggaaaggctccgccccaagagagcgggcttcagcacatcgcggacggcgctttcaataccgtccgtgctgtcgcctgtaatgacaaccgtcggcggcgcttcgccccagccggtcagaccgttgtcaaatgtgagcttcacaatgaccgattcagcattgtaaaccgtgcgcaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacggcgaagctcggtgaacaatggccgattttaaagcctttgagcgcgggcttccctgatttgacaatgtaatcgttcagcacttgctctaaagtaagcgacttttctttatgcttcggttcgcattggtgaaaatcacagaccaggattccggctgcgtctgacagttttccggccatctttaattgattcagcattctgtcgatttggtacggctcctcatcaatatcctcgataaacagcaatttgtctttcgtatcaatttcaaacggcgtgccgagtgtggacgtaatgagcgacagattgccgcccgcaagctctccctcggcccttccgcctgtcagcacctccagcggagaaatgtcctccgtataggtgaattccgtttctgtaaaaagctgatgatacgacgcttttgtcagaggatcagcatcttcaagcccgacatccgtgctcagcatcgggccgtgaaatgtgacgagccccgtattttgatgaatggcggtatgtaaaaacgtaatatcgctgtatccccagaaaattttcggattgcggcggattaagccgaaatcgatgccggcggcaatgcggcccgtgccgaatcctccgcacgcgcatatcaccgctttgacattctgatcactaaacatatcatggagatcatcgaggcgcgcccggtcttctcccgccaaatagccgtgacgggtcttcagcgcccggccgagtttcacttgaaggccaagctcattctctaaaaacagcagcgcggtttgcagcgtcccgctctcaggcgggcttgcgggcgcaatcacaccgaccgtgtcgcctttttgcagtgctttcggtttatggttcatgactttttcaatctcctttccggattgaaaagtgaaacacgccgctcctttaacggcaaaagagcggcatatgtttccgctgtaagatcaggacttttccgcccatttcagatcaatgtaaccgacggggtgccggacaatgcccttcacgccgctgttctgcagatgcacctgattgtaaaagtaaatcggaatgatcggagcctcgttcatgagcagcttttccgctttatgcatgagcgcaaaacgttttttggcatcggcttcctgttttgcctgcttgatgcagccgtcgtatgccgcgcttccccagccggtgcggttcatggaattatccgtttggaaagcctcaagaaaactgatcggatctgcgtaatccggtaaaaatgagctttgagagaactggaacttcagtcctttctgctcttctaaaaagacgttccattccatattggcgagcttaacgtctataccgagcacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggagttagtaaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggttccattttaacgttaaaacgatagaaatagagtccggcctgatcccacgtgcggacattttttcctcccatcagctgttcgctcagctctgccggcacaaaggcggtatccaaatcccccgactggaacatctgatagtcggtattccggtcactgaccatcgcccatgtcactttatccagttttaccgtctttttatcccaatacgtctcgtttttgaccatcgtcatgctgtcgtcatgcttccattccgtcagtttgaacggcccgttgccgacaaaagtttttgcttcagtgaaccatttcggatcagccttggcgaccttctcattaatcgggaaatacgccggattggacacgacgctcaaaaaataatcctgcggggccgccaatgtgacgacaagcgtttttttatcctttgccgtgactttcacgtcttcttgtttgccttttccgctgttaaattcttctccgcctttgatcatatagccgagaaaagcggaagatgcgcccgttttcggatcgagcatccgcttccaggcgtacacgaagtcttccgccgtgacgggatcgccatttgtccattcggcgttatctcggatattgaaggtatatgtcagcttatcagcggacaccttccagctttccgccatggccggttcgggcttattatcttttccgagcctcgtcaatccttccatgatgttattcaacggctgccaggaaacattattaaatccgatcggcggatcaagtgaggtcggctcattttcgttattgagccgcagcaccgtctcacccccctgttcttttgctttgccgggttctgtccccgcctgttcattggctgtacagcccatcagagcaaacgaaacaacagcaatcacaccaatcgcccatctctttttcatttcaatccccctttttcctctgctgcagtcagctgctgcttcagccgctctgcacggtgatcctgaagccagcagttgacgatatggcttttggatttcacggttgttgccgggtataccttttcacagacgatcatcctgtccggacagcgggcggcaaacgggcagcccggcggcggatcgaataaatcaggcggcgtcccgtcaatcggcgaaagctcactatcttccatatccagccgcggcactgaacgaagcagcccctttgtgtatggatgagccggatggtaaaaaatatcatgcctcgtgccgatttcggcgattttccccgcatacataacggcgactctgtcggcggtctgagcgacgacgccgagatcgtgggtgatcagaataatagacacgcctgtttttctttgaatcttcttaaataattcaaggatttgtgcttgaattgtcacatcaagagccgttgtcggttcatcggcgatcataatttccggctcgcagatcagagccatcgcgatcacgatccgctgccgcatgcccccgcttaattggtgggggtactgcttcaggcgggatttcgagtccgggataccgaccagatccagcatggcgagaacctcggattcagcttgttttcttgtcatggcgcggtgttccaacagcgcttctgagagctgatcccctatggtcaaagtcggattgagcgccgtcatcgggtcctgaaagatcatagaaatatcgcgcccccggattccccgcatttcccgatccgacattcggcaaaggtctttctgtttaaattgtatgcttccggattcaatctttgccgaatgtttcggaagaagacccatcacggcttgtgacgtcacgctttttccgcatcccgattcaccgacgatcgcaaacgtttcacctttatataaatcgaagctgacgcctctgacggcttttacagtgcctccgtatgttgaaaaagtaacatgcagattttgaacggaaagaacttgctgcgccatttttcctacctcctcagttttgggtctaacgcgtcctgcaagccgtctccaagcacgttaaacgcgtacatcgttaaggaaatgaaaaaagcgggaaaaaacagccgccaccaatggcctgataaaatcgccggcagcccgtcatttgccatgactccccagcttgcaaacggcgcctgaatgccgagtccgagaaaacttaaaaatgattccgcaaaaatcgccgccggcaccgtcagcgtcatttggacaataatggctcccatcgtattcggcagcagatttttcttaatgatccgaaatgttttcgctccaaacgttttcgatgccaatacgtgttcatcatgcttcatcctcagcacctgccctctcacaatccgcgccatgccgacccatcccgtcactgtcagagcgacgataatggaactgagccccggccccatcagcaccattaacaaaatgacaacgagcagataaggcaaaccgtagagaacctcgatgattctcatcatgacgctgtctgtccggccccctttgtagccggcgacgcctccgtagataacgccgatcaaaaagtcgatcagcgccgccatcaccccgacaaataaagagattctcgctccgtaccacgttcttgtaaacacgtcccggccaagttcatcggttccgaaccagtgtgaaaaagacggcggaagattctgctcggcgagcgtctgccttgtcacgctgtgcggtgatatcagcggaccgaacacagccgctagaaacaggcagcataatatcacaagtccggccatcgccaatttgttctttttaagccgccgccacgcatcctgactgtaagacaggctcggacgcttgaccgactcggtttcaccctttctttccgcgcccggctgaaaccagtcatcaggcacttctgtgtgttttaccgtttcttgcgggagattcatcaggatcaccctttcttatgaagttttatgcgcgggtctaacaggccgtatgccaaatcaaccagaaacagcaggacgatcagaatcacactgtaaaatacggtcgttcccatgatgaccgggtaatcgcgctgattgatgctttctacgaaatatttgcccattcccggtatggcaaaaattttctcgatgacgaaactgcccgttaaaatacttgcggcaagcgtcccgagtactgtcacaacaggcataagtgcgtttttcaatgcgtgtttgatcacaattttgacgggagaaagcccctttgcttttgccgtgcggatgtaatcctgagtcagcacttcggccatgcttgatcttgtcagccgcgcgataatggccatgggaccgacggcaagcgcaacagtcggcagaaccatgtgaacgggactcgtccaggtagctgccggaaaccatttcagatgaaccgcaaattgctgaatcagcagcgtagccattataaaattcggaatggaaatcccgagcaccgcaaggctcatggccgcataatcgagaaagccgccgcgcctcagagcggccgttatgccgagcgcgagtccggaaatcacagcgatgatgatcgccgttatcccaagctcgaaggagacgggaaatccgcgttcaagcatggcgtttacactgtctgacggttttttgattgaaggaccgaaatcaaaggtaagaatggattttagatagatggcgtattgagtgataagaggttcgttcagatggtagtaggattcaagatttcgctggaccgcttcgtttgtgccccgctcttcgttaaaaggcgagccgggtatcactttcatcatgacaaatgtcagagtggtgatgacgaggacggtcatcatcatggcgataaaacgtttgataaaataccgcagcaatgccgttcacccctttaacagaatgttgttctcatagcgagttctgtcatgacgagcatggcctgataggcttccggcatgtcttttgcctgaaattgaacgattgtcgttcccgggatgatttctgtgcccggcattaaatgggcccattcagcctgtccgtaattggcaaattcaatgcctaatacaggtctttcaggcggagtcagcggtttgaccttatctttatttttgagcgcataggctgttttttccgtcaggagccgtccggctttttgaggggacaagcatttgaccgcagttcttgaaatggtttgtttgacggcggcagtcgtcacattcgggatcagctcctccgcctcttttgcggcgcaatcatctccggcagccatgatgaccgggacatcgtaaaatccggcgagataggcatttaaccccagttcaccgacaggcttatcatttatgtaaaagtggcggacgccgaatatcatgctgtgcgacatgacgcccggcatcgacgctctcgcatgatagccgataaacatcacacctgaatacgattcatcaagcccctgcatcatggaaaacggcttgacatcccccgtaatcagctctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgcgggaattgacaaatgtttcatcaggcagtccggaaatcccttccatatccacagatagatacagtttcatgtaatgcctccttttttatttaaaatttcgatattaaattatgaatattctaacaaattatattaaaaaaggatgaaacatgcaatataccattctgccattatgggaaaaaacaaacccttttcaccgggaaaagggtttgctgatagaaaaagttacataccgtttttgtttatagggtgaccccgaaactgtctgaccgcacttctgtattcgcgatcgggaatgacctgatgcctgatcggtccaggatcctgcggcgaaggctcttcatccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggcgattgtgtgccgcgcgcgccccgaagcatgccggaagcatctcttttcgtaaaataccctattaaaacaggtgcgcccatataaatgaacagccttaaaaactgaacggccgtcatgcgtttcaccagttccggaagcggtccgcccaacgcggcgcccatcagtccggctgctacgataagccctgtcccggccgccagcatcacgaaaagcgccgcaaatagaataaacggtatatgatgacccgccgtcatccattggaaattcacgaacaccagtatgacagagcctgttatgccgagcatgcccggaccgactttatcatatgctaatgcactgagaacagcggcgatggccacgcctcccaaaaggctcgcatataagaatatcagttgagtttgtgacatgtgatatgcggtctgaagctccccgtgaaatgcagaaagactgaccgctatggaaatactgcccgcagcgatcatgaaaacacccaaaatcggctttggaatcagcataagtttaatcgaaatcagcgcatgttcgtttctgtactgcataatcagcaggatcagcagaatgacgatgcttcctccaaatcccgccaatgtctgccatgatgaaaagccccatttcggcagatgaataaaaatataggcggtcagcacggctgatccacccgctaacagaaaaccgatgccgtcaaatggagatttttcagtatttttatgagcgtcatcccgcagccacatataactgaaaatgaggccgaaaaaagacagcaggccaaaaatgccgaacagccaatgccaatggccggcgcttgccgccgccgtgcctaaaacggtccccataatgacggacccgtaaaatccgccgattaacacaaataaggcgtaattccggcgttcaatcggaaacgaaagcaccagcatcggaatcataatcatcagcatagtgcccgccgcagctccctgtaaaaaacggcccgcggcgagcggataaatatcatttgtcacagcagcaagcagcgctccgatgacacccgcggccatcgaaatcatatagacaggccgggagccgaatctttttcttaaatacggccccgccggcacgaataaggcaaatgccatattaccgataataatcggatgaaaagagtcaaagttttccccgccgaccgtctgccggacaaggctttggacagccgaaagagcggtattcgacatcagccccggcccgacagccagcacagcaagcagagaaatgatccagtgatgtttttctttcatttgacagctcctttcttaactatttgacaaagtgaaaaagctaacagatttcccccattagcttgacagaattttttatatcttttcatgtgaaggattgaacataatatcccatttattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagccggccggatattccgcgccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttctgaatcagacagcggcaaatcggcaaacagctcatcggcaaattcaagcagcatttcgaatatggtggaagacatttcaccggcgatcgtcggaatcaccaatctgcagaagcagcaaagcagttccgatttattcggattcggatcaagctcggattcaaactctaatgcatcgggtgatgatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggccgtgattcgctgacggacttggccgtattagaaatcagtgataaacacgtaacaaaaacggcaagcttcggcagttcatccgctctcagaacgggagaatccgtcatcgccatcggtgatccgctcggaaaagacctttcccgcaccgtcacacagggcatcgtgagcggcttaaacagaaccgtctcgatctctacgtcagccggtgagtcaagcatcaacgtcatccaaaccgatgccgccatcaatcccggaaacagcggcggaccgctcttgaatacagacggcaaaatcatcggcatcaacagcatgaaaatcagtgaaaatgatgtagaaggcatcggctttgcgattccgagcaacgatgtaaaaccgattgccgaagagcttctcacgaaaggacaggtggagcgcccttatatcggcgtgagcatgatcgacttggaacaagtgccgcaaaactatcaggaaggcacactcggcctcttcggcaaacagctgaataaaggcgtttatattcgtgaagtggcgcagggatcacctgcagccaaagccggattaaaagcagaagacatcattatcagcttaaaagggaaagaaactgacacgggcagcgaacttcgcaatattctctacaaaaatacgaaagtcggcagcaccgttgacgtgaagattatcagaaacggcaaggaaatgacgaaaaaaatgaaactgactcaaaaagaagaaacatcttcttaacaaaaatccaaggcagccgccttggattttttatatacagatgaaactttaggcctggatcagccgtatgactcagtgtacaaaggaggatacatacacatgaaacaaaccggacttttgctggtcgttaccggcctgatcttgctccagctgagcattcagcttcctcagcaaaatgctgcttggggaatgacgcttggtgcaagcattttactgaacctttcgggaaccggactgatcatgcgttctctgcacaaccagaccggccggagatgaataaaaaaagccgcgggacattctgtcatcccgcggcttttattttacataaaagcaccctgtccgctggccggacagggtgtttgttaagacatatgctggtcccgataaatcttttcgtttttcataccgtacgctttttgcacgatatagagcggacgatcttttgcttcgtcataaattcttccgatatattcgccgatcattccgagcattaatagaacgatgccgctgaataacagctgtatcacaatcagagaggaccagcccgtaatggtgctgtctgtaaaaagcttcatgtataaaacgataaacatatagagaaaacccgctccggacatgagcattcccgcatagcttgccgccttgagcggtttatgagagaacgttgtgatcccgtccatggaaagcttcagcatttttttaagcgggtatttcgtttcccccgcaagccgctcatctcgttcatattctacagcagtctgcttaaagccgacccagctgacgagtcctctgacaaaaggatttttttcttttaatcttttcatctcatcacagacttttctgtccagcaggcggaaatccccggtgtcgagcggaatatcaatatcagtcacgctccgcagcagccggtaaaacagagaggccgtctgtttcttgaaaaaggtttctccctttcgtttcgttctgacggcgtacaccacatcgtagccttctttccactgttcaatcatatcaaggattaattcaggagggtcctgcaaatcggcgtcaatgacggcgattgcattcccctctgcataatccatgcccgctgtgatcgcgatctgatgtccgaagtttctggaaaaatcaataattttcactctcggatcaatcagactttgctctcttaaaatctcaatactgcggtctttgcttccatcattgacaaagatcaattcataatgctcttttgtttgatccatgacttctttcaggcgctgataggttgtctgaatgacgagttcctcgttataaaccgggacgactattgaatattgaatatgtctgctcatgttttttcctcctattcatcagattgaagttcgtatagtgaagctgactgattcattccgcccggcccgccgctcattcggctgtttttacccgcggccttgctgctttttgtatcagttgcatcatgatttttcgttttctgatctgtgcttgattgccatttgtatgaagatactttctttccgtttttctcaacccattcaacaatatcgttgtttccgcctttgcccattccggatgttaagaagtattttactttcccttcttttacgagctttttaaattgagtcagcgtaatggccgggtcagacccgctgaatccgccgatcgccatgaccgcttttttcgtttttataatgtaaggcgccgctgtgttggaatcggttgcagcaaatagataatccgctccggcgttatgtttctctaaatagttgatcagttttgtattgacagatgcgttatccattcccatgccttttccgcctgctgacgcaagctgagggcctgtttcaggcaatgagctgttgcctccgtacagaagcggtgtgctcgcccaataaatcggcatcaccatcaagacgagaagggctgcaagtgaaacatagtaactgagcggtttttggcgctgtttgaatacgaacagggcgattgccgccactgcgccgagaacgcctgctccgatgctccagcctgcgccgatttgatcattgtagtttctaaggataaacagctcaaatccggttgtcacaagaatagcggccggcaatagccaagttttccatcccgcctgcttgcggtacagatgaacgagggcgacccatcccgcaccggtaagagcagcaatcggaggcgccagcataatgagataataatggtggaaaaattccgccacactgaagaatccggcaatcggcacaagccaagctgcccaaaagatcgtttccttctgttctgctgataatcttcttctttctctcgctccggcgatcaataaaccggccagtccaaaaatcgcaaacggcaggagccagctgatctgatcagataattcttgttggaagagtctcagcggaccgggtgttcccgtaccgaacattcctgaccctgactgcattttcgagccggtgcctgtaccgcttttccctccgccaggaccgcctttgccgccgtctccgccgcttggagggcctccttgaccgccgcttggcatttgtccgttagatggaggtgccgtcatactgccggtttgtgatttgtctccgcttgctgactggccgggcggtttttgcatttgtgaagaaccgccggaagaagacatctctttcgatgcgtttccgtcgggcccgccctggccgccgccggaactttgccccgtcagccgctgaatcccgttatatccgaaagccaattccaatacggagtttgtctggctgcttccgacatatggccttttgccggcaggaatattgtcaacaatgagcggccatgacaatgaaacggctgctaatacggccagcgcgcttaccagtgaaatgatttttttcttaatcgcggtatttgccgccatcatatagaacagcaagaaggccggtaagatcatataagcctgaagcatttttgtgttaaagcctactccgacgacaaaaaatgccgccaaaagccagatcagttttccttttcgaatcgctttaaagagaagccatgtggcgaacaagaggaaaaagaccagtaaagcatcgacattgtttgtgcgcgctacggctacagcaatcggtgtacacgccatgacaaacgaagcgatgcgcgccgccgtttttccgaacgtcggctttattaataagtacatgaatagaactgaacctacccccgccaatgcctgaggcaggatgacactccacccgtgcataccgaatatcagcgcgctgatcgtttgaatctggtatgtaacaggcggtttatctaccgtgataaatccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaatgaggattaagactgcgtctatctcgcgttttttcattttcacctgtgttttcactccttttgtttaactttgaacaagtgtaacaaccaaatgtgaaaaatttattaataaacaaagacaattattttgccgtttacaaataggtaaaaagaatgacaaaacgggtaaaaaagcaaaaaaaagatgcccccgtcaagccggaaggcatctgtcattatttctgatttactgaatcggtttcagccgcgcttctatttcagaacggcggtgttcgagataaggcgggagcgcaaccgttttgcctagctcctcaggtttttcatcaaccataaatcccggaccgtccgttgacaattcaaacagaattccgttcggttcccggaagtacagcgctttgaaataataacgctctacaatgcctgagttgctgaaaccttctttcgtaatgatgcggtgccataaagcaagctcctcctcattctgaacacggaaggccacatggtgcacgctgccttttccaggacgctcgcgcggaagatcgtttctttcaatgagatggacttctgtacgcgcgccaccgtttccggattcgagcaccgtaaccgtgccccggtcttcatgtgtttctttcccgatttcagtgaagcccagcacatcggttaacacacgcagcgtcaattctgcatacgggacggtcaattcaacgggaccaagaccgcggaaagaatattcttccggtatgccgctttgcttcaccgcttcaccgatgtcttttcctttttcgtcagctgtcagcacaagccgctgtccttcatgatcctgaaaagcgagtgtgtctctgcccgctattttcacgatctcaccgtgagagacctgatgctcttcaaatcgttttttccaatattgaagcgcttgtgcatccggaacacgcaggccgattgaagaaatactgtttgtccccgcatggaacggcgcgatccgcggaatctcgaaaaacgtcaattccgatcccggattggctgattcatcaccgtaaaataagtgatacatcgtcggttcatcctggtttaccgattttttcacaagcttcagccccaggatatttcgataaaaatctaaatttttctgcgcatcagccgtcaatgctgatacatggtgtattccattaactttcattatgttatcctccagtcaattatctcgatttcgagatattttatatatacaatttatgttatccggatcgtaaagtcaacccatctgcttcacagacggtctgcagactgccgctctcaaaataacgaacttttgatattaaaaaaaccattaatgttcgcttttaaaacagtattttttccttctcaaaagcataaacctttatcttttaggcaaaacaccaaaatcagaaaatttattttattcgtgtttcagcaattagggtttacaatatggaaaatagttttttcagcataacgattttacatctggagggaaaggatatgcagattgaagagaatggacttaaaaaagagatcggccttaccatcgccctctcacttgttatcggcaccatcatcggttccggcgtatttatgaaaccaggcgccgtgcttgcctactccggtgatgcgaaaaccgcgcttatcgcgtggctgttaggaggcattttgacgcttgccggcggcttgaccgttgcggaaatcggcactcagattccgaaaacgggcggactttatacatatctggaagaagtgtacggcgaattttggggctttttgtgcggatgggttcaaattatcatttacggccccgccattatcggagcaatcggcttgtatttcggctctttgatggcgcacttgttcaattgggattccggctggtctaaattaatcgggatttcagccgttttgtttttaagcatcattaacattatcggaacgaaatatggcggcatcgtacagggaattacgactgtcggcaaattgattccgattatctgcatgatcgtgttcggcctttggaaaggcgatcagcatattttcacagccgtcacaagcagcatgtcggaaatgaatttcggcgccgccatactggccaccttgtttgcttatgacggatggattctgcttgcggcactcggcggcgaaatgaaaaatccggaaaagctgctcccgagagcgatgacgggcggactcttggtcgtcaccgccatttatcttttcattaactttgcgctgctgcacattcttcctgcgaccgacatcgtcaaactcggtgaaaatgcgaccggcaccgctgccggaatgctgtttggcgacatcgggggaaaattgatcagcgtcggaatcatcgtcagcatcttcggctgtttaaacggaaagattctcgcttttccgcgtgtctcgtttgcgatggcggaacggaaacagctgccgtttgccggacagatttcgcgggtgcatccgacattccgcaccccgtggattgccgtgtcatttcagatcgcgctggccattattttcatgatcgccagcaatcccgataagctgtctgagatctctattttcatgatttatattttttacgtcatggcttttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgcgctgtccctcttgatcggcctcgccgggctgccgctttatttttggctgaaaaacggcagaaaaaactgacaaaaacggttccttttaggggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttcagatgagcatatcgataagttcagcggatacatcagagagtgcgcgaaggaaattttaatcacgattgagctgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgagatttacgaaacgcttgaggaaattgccgactcttgccaaagcgttgccaataaccttgaaaccattattatgaaaaacgcgtaacgaggggttataatggatactctattacttttaacgatattaattgtcatatgcgctttggtatttgacttcattaacggatttcacgataccgcaaacgcaatcgccacctcagtttcgacaaaagcgctgaagccgcggcacgcaatcgtcatggccgccatcatgaactttctcggagcgatgacatttaccggtgtggcgaaaaccattacgaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcagccattgcagcgtcaggttttgcgacgcttaattataaagggttcattaagattatcgaagcacttattttatcgccgattatcgcctttgttctcggctttatcgtatattcgatcgtgaagctgatttttaaagacagcaatctggcgaaaacaaataaacgcttccgcagagtgcagattttgacggctgccattcaatcctatacacacggaacaaacgacgcgcaaaaagcgatgggtatcattacgatggcgcttatgacggccaatttacataaaagtgatgccattcctttttgggtgcagctctcttgcgccctggcaatgggtctcggcacatccatcggcggctggaaaatcattaaaaccgtcggcggaaaaattatgaaaatccgtccggtaaacggcgtatctgccgacttaaccggcgcagccattattttcggggccacgtttattcatctccctgtcagcacgacgcacgtcatttcgtcttccattctcggtgtgggcgcttcccaccgcgtaaaaggcgtaaactggggaacggctaaacggatgcttattacatgggtcatcaccctgccgattgcaggtacactcggcgccatcgcctttttcatcttagatctctttttctgatgacatccgcttctttacagaagcggttttttttgtgacaggaaaatgatgtcatgacatagaatgaacatagcagaccatttttcgaattgtgagggatgctcatgcttttgttttttcagatcatggtgtggacgatggcggccgcactcattttatatgtgtacgcatcctggcggtatgaagcaaaggtaaaagaaaaaatgtttgccatccgtaaaacgtggtatttactatttgtagtaggcgccatggtctattggacatatgatcccgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatggagaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccaggaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgataagtataaacaaaaaaaagcttgattacactaaggacaggagacacggctcttgtccttattccttttttccatatctttcatataataaaaccaacaaagagatgcgacaggtgatgatgtgaagaaaattgtcagacgcgtaaagtttgtggattacggacgcttcgggctttccgcttattcgctgaggatgcgggcgaggaatctcgggttattgaaccggttaaaaaagaaaaaaggctgaatcccgcaatgtgaacgggactcagctttttttgttaaagctgcatcagaattttcgcttttacagcgggaccgtagacgccgtcagacgtcagtccgtttacagattggaagcgggccacggcatctgccgttttcggaccgtagataccgtcaatgccgttattgacagctcctttttcaggatagaaataaagcgcggcgagcgcgttctgcacctggtataccttttcaccggacgtgtacggctctgtcagcttgatcacctcgtccggaagagaatacagtgcttcaaccggcgggctgacgatcagcacttgtccgactttaatcaagttcgggtcagcgatgttattccatttctgcagatcggccacgctgacgccgaatttccgcgcgatcgccgacagcgtatctcctttttggacggtatacgtctgtctttcctcagaaccgattcccgctttaaactcatcccatgtatccagcagtcttctcggacaaagctttcctgaccaatgcttgtgcgcaacgacattcgcaagcgggatgccgtgcgacgtcattaatgtgcggatgagccattgggcgtttgccacggcctgtgaaaagttgccgtcagcgttttcacaaatttcaataccgatggatttacggttgccgtccccgtttccgtcaccggcatgccagccgttttcgttcagcggaagatgctgataaatttccgtatcatcgactgtgaaatgccagcttgtcggtgtatcgggatttttcacatagcttgcgtgacttttggcgttagctccgactgcggtattggctgtattgtgcaccgtaatgtaaatcggtgtcattgcatagcctgggcggttattgtttcctgccgggataaaatcctgtgtgatttttaccatattctcatctctcctatttcgataaattgtttatttttaataaagcctgctgttttttcccttttgctgtaacataattgtttttaaaccaggcggcggcagtcgttatgattgtaaaaacggccgacccggcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcgaatttcatatcggtttcccccttacttttgcagcagattgtacatgatggcgatggctccgccaatgacgcccgtgcagattgctgtcacgatcgctcctgtaatggtccgcttaatccatgttgtgttttcgtcaattttgttcagtttttcattcagcgtcatgatttgctgatcctgccggtctgatacccgctctaatgcggctacccgctgttcaagcaccttttgttcacctttgatgtctgcgaattctttttgcaccgcttgttcatccagaagcacttccgctccctcctcttacattgttctcacctcccttcggaagcttcattcttaagaaaatgccgtgcctttgacagaaaggctcccgccggaaatgctcttgatttccatgacgatttccttaaagccggcaatatcaaatgcccacacttcttctgtgcctgacgtaccggcggctgatgtcccgtcatcagacctgattcctctgatcggcacattttttcccgagatggatctcccccaaaacgcgacatggcccgactcagccgtgccggtgatttcgacgagaagttttttccaagcgcctgctgagaagatgcttccctcgcccgcctctgctgcattttcatgaaaaatcacgtctgtatatgaaaatgccatatcaccgcccgtaccgacagattggtataaaacaaattcggactgcttttgatttccattttcaaaacggaaccggtaatatctttttgtcaggctgacccaccccgaagcggtctgcactccgccttttactgcgacagaatgtgaagctgtccacgaattgttatcctcgctctcttcgataaaaagagttccgctgcggtccgaataagcccacccctgtgctctgtttattaagacggctcctaaacggtcttgtccgaattggctgtagacttcaatcgcttctagcggcgtattggtaagaagctctgccattccggacaaatcagcaaccggtgtgacataatcgtttttgttaccgcgataagcttttacggcgccgggcctgccaagttgatcggcgggaaattcaaatgaatgctttttcatcggccgtcctccttttctcatttattaaaaatgacaaataaaaaaagccgtttggcttatgacacagcatttttatagttttcgtatgtttcacccgttatttcttgaaattcctcaggcgtgatatacttcgcggccacaccttcagccagatcttcggcagagcagtcatcatagcccatagcctgttttaccatttctgttgaggcccactcataaaacaaggcgtaaacccaaaagttaagttttttcatttttttcattctccttttacgtttaagagttccagttttaaagacgctaattgcctgccgagtgactgctgcgcttgttcggctgcttttctggccaatttctcattcgccagctgtccgccgaggcctgcaagctggtttgaatcgggagccgtatctttttttaagctctctttatatgcttcgtcagcggtttccacccattcttgtttctcttcatcaaaaaatgggcgccacatcccttcgccttttatttccggcggtaagtccgcagcgttaggcggcatcacataatctcctgtcttagaatccggataaagctcaaccggagtgcctgtataaatgttgtcattgtcatacggaaatattaatttcatattctcgctcctttacgtgagtgccaaaacaaggtcaatataatagccgttcacgttattttctatattggccataattcccgtcagcttcatatctccattagaatagattataaatttgctgtaaccggtggtgccgctggctgcaaccattgtcacaacgcctttggccggcgcacaagaggacggcacactcccgaataccacttctctgtccgtaagaacgtgtccgttcaggtgaagggtgtttcccactttacggtattgaagcggcctgtctcctgatttagcgccatttttataaggaacatttatccaaggtacattctcagtatcaagttcagtaacgaggcgacgccagccctgccagcccaagttcaaatccaaatagttcgtgaacatattatttttataatcgacggcaatgacatacccaaacgttcctttcccctcactgtcaagagaggtaaaatgaaacatgccgcgggttgaagcgttgctcggactgtttgccgctttgccggttgaataaaaggtgccgaacgccctgccgtttttaacgattttttcaagaaagttatcatcatcaccaattgtcagaagatagccgccgttatcgtttgttattttcgaaagctgtgcgccgttccacatatctttatccgcctgtgtgacatggatgtcttttttattggcgtgagcctctacttttgcttgagagcctgaatctgtttcttgttggctccattccgaccatacgcctttagtgctgaaacttcggacgtatatgggatttccggcggtcactgtgtctataaacatttggacaaaagtcggtgatgctccgcgggttctttgcatgacaattaattgtccgtattccgcaggcttattttctgtatgctgaactgatatatagtagatgccggacgtttttatattgtctaagtttgtttctgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcatccattccgtccagatgccgtttttcagcgtttttctccaaaatcccccgtcatctgagaaagcggccgcctctccgttattctttgaagaataaaggtatataccctctgacggtttaggcggggtatttattccggttgcagctgctgagaaagtaaaggtcttattctggctggcagcggtctgatgaaaatcctgtccgtcagagatattaataaaagcggagccatcatcttttgtgattttagacaattgcccgttattccacttctggcgctcttctttcgtcacatgccggtccagatcttgattgtgccggtcaaaatctttctttgctgcctgctggacattgtccacgtttccgaggccgatttgcgcctttgtcgttttgtgcgggttgttcatgtcgtttttatgggccgccagatccgtgtgggcgtcttttatgcctttttcccagcggttgacgtcatcttcattaatcggatcgtccggaagccagtctgttttttcttcgtaagccatcgttacaccacctcaaaggtaaatcttaaatcaagcgttctgttattgctgagatctaaatttgtttttcgttctgtaataacgcttcctgtttcgtcaagcatctgcacggtttcaatgtgtttgacgtctccttccctgcgtgtgagaacggtgactgcggcatcttttacggaaatgtccgcaatcggagtttctttgccgtttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacataagctgacggatgttttaaaaaacggtttagcgcctgctcgatcgcttgatgtgtgatgggcggaatattcgacatcttcgagatcagcctgagccgtctcatatcctccgtgtcacctgattcccgcggtatttttaatattttttcccagcggtcaagcccccatgtcgccgtcgtgataaagagctgatccgtcaaatcgaaaatatcgttattctgccgctcaaactcaggagcttccgccataagcagttgtgccatctcttttaatcgggttaaaaacggcgggaggtacgccgtcatctcatcgagtctgctcaaggattttcacctctttgagtttaggaatttccacgtcactgagcacgaggttttctgccgcaccgttcattttaatatcggcgtagtcactgacggatgccgagttataaacgatgttgttaatttgtgataaacggacggtgttttcttcaaaggccattttcttgaataaattcagtacgcctttttcaatctccgcttttacgtcatcgatcgagctgttcagctcaggcagcacggaagcggagatttcgatttccttccatactgcgctttccaccgttactgccgctccgatcggcgcctgtccttctccctgcccttcgtccggatcaatataatcctttacttttttgatcagaatatctgatgccggttccaaattcgcatttgtgatgacaactttcactgttccgtctccgttccaaagcgggaagatttttgccctgccgacgccgtcaacctcttcggcccattgtttataatgctgtttatttgcgctgactgcctcccggcggacacgggtaaaatagcgcgcccttaagctgttgtcatcttcttcctcacggccgggaattaatatatcgcgcatgactgctttctcaagcccgggtatcgtatcaagcggcagcaggttctgccccgaaatgccggcattgcccgcttcaccggctgtttcacattcaagcgttccatcccccgtatattgaaaatacaggttatcaacgaagaaacgggagcctggcggaatggtgatgcccgctgtgaattctccggctctgaccgctttagtggcaggtgttcgttcaattcccgcctcagcagcacgcctgtccagaaattcaccctgagccgtatcggaaaacacgagctccagcacggtatccagccaaatataagactttgcgagctcagcggccgcaggcgcgagcgcattgtaaatgacgctgccttctctcgtatcaatatccgccgtaacgcgcgccagcattctgtccataatgtcgtcaaacgtctgagcttcaaacatcctcacccagcacctcctctatctcaagcatgccctcatcagtttcaacggtaaaagagacgatgaaggcatcatcttttttctcaatctcaaaattggtaacggccaaaatacggtcatcatacagcaaggcttcttctatcagtcttggaatctccatttttttataagcatccgtcgtgttctgatctgaaagcacttcctgaagttcgtttccgatatcatggctgaaaaccgaatatgaataccgttctgtgtgaagagcgatatagacgaattgtctgattgcgtccagtccgtttatcagttcattggtaatccggttgttttcaaagtcaattcggtaggtttgtgaagtctcaacggcctcactcgcatcctccaaatcttcaaattcgatttccggtgtcagggccattgcacccgctccttttagatttgttcatgtaaaaaagccctcttcggcagatgaagcggctttaataggctgatattcccgtatatctccgtccggatgccggttaaattttgtccagtacaaagaaagactgtcctcctgttaaagcggcggtcatcacccgatctcccgcctggagctgatcatcttctccggatctcagccgcttcggcacaatgagtgcatcagacggaatcaaaagtttgtcgtgatctttcagtttcagctcgagcggcgaaacggaggtcacttcggccggcatcagctccaccggcgcttcagcgtcaaccgctccgacagctaaatgtttaatggcatcacttaatctcatcaggctgtcccctccggaagtgaatttttctccgtgacgtcaatcgtcatggtatgttttgttccttggaattcatggcggtccgtatctacataataggttttcttcagcccgatttccggaattgaaatatagacgggcaatccgctttccaacccaggaataccgatcgcctgtatatttttcagctctttcttaatgccttttttctcagcctgcttcacttttgcgcgctgtttcagctgggcttcgttaatgtcgtcagaaaccgtttcggtatactgcaaaacgccgaatgttttcatgccggcgctgtctgaggcggaagcctttatcgttttattgtctttttgcagccgcatgacgacacgggttgcggtgtcatcaattgaggtgctgtattgataccctgtaatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatagtatggcctgtgttggcaatggatgtgacgggaatttgaaaatcgctggcgatcctttttaatatttgatcagcgcgcttgttggaaaacacgtaaacgtcctggtttttcacaaggtattggagcatatcgtatgcggtgaaggcgacggtatgctcatcgggcgttcttgcaaaaacaatgccgcggaacagctcttttccgttccatttgaacaaaaccgtatccccttctgatacgccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgcccaggctgccggatattccgtttgctgcgcttaatcatggcggttttattcgcgttccagattttccgccactccgtgtgttttccgtaaaacttgccggcgatgtcccaaagcgtatccccttttttgacggtatatattttgggtgaagctttggacgggcgcttcgctttcgtttttttcttttgtttgatttttcttggcgaagcggttttatattctttcagtacgatatcaaaattccggtcgccgatttcattgtcaccttcgctgtaattaaagctttcaatgctgcatgtgacattgatttttgtccctgtaatcaaaaactgaacgggttttttcgctttcatccatgcttcaatggctgaaatggctttttccggtgaaggaatgctttgatattcggcaatcgggctgtaccgtttcggaaaaaaagaagagaacgaaatttctttcgctcccggttcttcgataaacgtcacctctccaagtccggtgactttcacggaatcattctgcacgctgtttgcgatatcaatcgcttcagggagaacgggaagccggagcttgtccttcccctgagacagccaaaattcgtaaacagatttagtcaaaagcaacggccccctttgctccggtataaatgtctttttgcagttcatcaatcagcgcctgtttgattttggcggcgaggctgtcggcgtcctgtccgttatggaaatgctgattgccgctgaattcgattttaatttcttttgttcccgttttttgaacggtttggccgccgcctttaacggctgcggaaaccgtgccggctgaaagcgccgccggttccgtccgggacggatcggacacttccatgccgagcgcctgagccgctttttgcagcagataacggccgcggatgccccgctcttcagggatgatccactcccgtttgttcccttcgccgacacgggcgatctgctccttggtaatcagacccccattggcataaccgacgtaagggccgccatgagccatacttttaatcccggggacattgctgattgagccgtatcggcttttaatatagccgatagcggcagcggcgttgtggattggatttctaatatcattcatgcccggcgctttgtgatcttcaaaggtgctcggaatcgtctgcataagcccctgtgacgggtgtccggctttggcgttgctgtcccatagattaatggaattagggttgccgcctgactcatgctgtgcgatcgtcattaatcccggaagccagctgatcggcgtattggttgctttcattgcggccaaaagccattctttgacgcttcctcccgctgcacccataccggaaaaggctgctgcaagcgagcctgcctgtttttccgcatattttttcacgtcaactgagctgagacctttgacgacgccgactgaagcaaagcgtccgagactcatcatgacacgggaaggagagtgaatatcaagctcttccctgaatgcgtcctcgacttttttggccatatctttggccgcctgtttgacttcgcttccttttgcagtcattcctgatacgaagtgtccgatcaggcctgacccccagccgttcgcggaatctcttgattgcacaaacggtttattgatatgtgtgcttacgtattgcgacgttcccgtatcttttgcattctgtccggccgaataacctttcactgtggcggcgccccatgatgacgattgattaaccgccgattgataaggtgttttcacctttgtttttaaaaacgaatcggtgcccgtcggcgatgtattctgacctttggcatagcccgcagcgacttgctttccgtaatcgggcgaagacgaaataagggcgttaaacggcgttccgatgtttttctccttccagccgtccatatccaccgctttattgctgattccgctgtcaaagccttcagtaaactgtttgccgagtgatgaagccgtccccgcaaatccggaagcatccacagacgcagcggccgatacagacgccgaagaagaaacaccgcccgctcccgccggcacagcggaagactgagccgaagccgcgcccatatcatcgacaacacgcatgccgagcttagacgcagcttgtgaaagcagcatcttcccccggccgcgattgttgtcgacggggatgacaaattctttaccggcttcaccgatccaggaaatggtcggctttgtaatgtagccgcccgtggcgtttttgtccgtttttttctttttatctccgccgcctcctgtgacaaagtccattacgcctgaaatcaatttgccgccggttttatcccaaatctttttcacccagtcgaatgctgcagaaaaagcatctgatatggctgttcccacttttacaagaggttcttttatatgtttctcaaaccagccgcttaaccctttccatatatcctttaccgtatctaaagcagtcgtgaaagcgtctgatattccttttccgactttttccaccatgtttttcaccgggttccagacaatatccatgaaccagccggataccgtactgaaaacagatttaattttatcccaagctcctgtgattttactccaaatggacgtcgctactccgacgacagccgattttacgggctcccagacagtgctcataaaccagccggatactgtgctgaagacaccttgaatcgtcgtccatgcattcacgatatttgaccagatgcttgtcgccactccgacgacagccgttgaaaccggcgtccatacattctgtcttaaaccagttcatgatgaactggtttttttatttgaaagatcacatagatatataaagctaatgcctttcaaaggcattagcttttttgtttacattgattttgctttgctgttgtgattttgaagattgtttgattttattgtctcgagtattcttaaactgaacacaatcagcagcataaggaccatcagtgcagtaaacagccagaacgcagtttgtgcgggatattcatctaagctccagccgacggcgatcggaaggagtgaacctcctaatccgtttgaagcgagcagaatactggtagtcgtttctgtctttccgggataaaaatgattcgtgatgattagggctattgcaaacatgcctgccatgaacagccctaaaaagaagcaaagggcaaaaccgaaccatacgtttttacttagtgccaatacggtaagtgctgccagaccgccaatgcttatgagacgaagataacggtgatatgtcagcttttctgataccgggcctgttaataaccttccgatgatcatccccgtccaatacactgtaactgttatcgttgccaaagagttggggatatcccatttctcagagaaaatggaggggataaaatgtacaattgaaacttcactgcctccgtaaaagaagaagtaagcccccgccaaggcaataaacagcaatccgtgtgaccgataaccggtgctttcttttttagtgtcatcggaagagacctcttttcggatgagaagctgatcaatactgccgaaactcatctgcttccatgcgattaaaagtgcaaaactggataaccctaatactaaaaaagcaattgtccacatgtggttgttgataagaaagcctgagagcagaggcatgaaaagcgcacctaatccgtaggccacttccatcttgctcatggccacagcctgtctttctttaatagcggtgaggataatcgtgcctacacaggattccaccaatccggcgccaagccccgcgatgctgacgagaagaaagagcagcggccagggcggcaggaaggtgatgaacatttcacagctgatgagtgccaggccaaagataacgacgtttttgcgcccaagctttttcaccatgtatggcatgccaataacaccgatgagaaagcccatgaactgagagaataccaatactccgccattactgtagctttgtgaataatgtgtgagtaactcaggcagtacggctcccagaataacaagtgtaaaagcaatcgatccataagaaaaacagcttatccacagcagacgagatttcatcattttatctccttattcgtaaaataatatttctctctactcgtatgacatgacgtttttacaaaaaatccaagtattgttactatatcacataactttttctcgtacatcccttatggtaacgttaacaaattgttaacattttttacaagaaagatcgttgacattattttcaataattaatacgataaaaagcgaaattctaataatttcataggggtggtatttgtgggaacgaaggaaatcacgaatccagacagcttgtattacagtgttgacgatgtagtaatggagcgcggagaagggatttacctgtacgatcaagaggggaatgagtacattgattgcgcttctgccacatttaacttgaatttaggatacggtaacaaagaagtcattgatacggttaaagaacaagccgataagctgatccatgtgacatcatcttttcaaacagacgccgtaaataaactggcagaaaaactagtagaaatcgcccccgataatctcacaaaagtacaccctaaagtcagcagcggttccggtgcaaatgaaggagctattaaaatggctcagtattactccggaaaaaccgatgtcatctccttatttcgaagccacctcggacaaacgtatatgacttccgctttgtccggcaactcattcagaaaagaacctttcccgccgcaaatttcttttggccttcaagtccccgatccgtattgcagccgctgtttttataatcagaaacctgattcatgcggtatgctgtgcgtagaaagaattaatgattttattgagtatgcgagcaatggaaaaattgccgccatgattattgaaccgatatccggaaacggtggaaacgtcgttccgcctaaagagtattttaaacagctgagacagctttgtgatgaacacgatatcgccctgatttttgatgaaattcagaccgggttcggacggacgggcaaaatgtttgccgcggaccacttcgatgtgaaacctaatatgatgacggtagcaaaagggctcgggggcacaggcttccaagtcgccgccactctgacggaggacaagtataccgggcttccggggtatacgcactccttcacgtacggctcaaatgtgatggccgccgctgccgcgtgtaaaaccatagatatcatgcagcgtccgggatttttggaaaatgtaacgacggtcggtcattatattatggatcgcttagaaacgatgaaagaggatttcgcttttatttctgaggtaagaggcgtcggtcttatgatcggtgtggagattgtaaaagagaacaatgaaccggatgtggagctgaccaattatattgcaaaacgggcaatggattacgggctgattctccggacatcccgttacgggttcggaaatgtttttaaaatccgaccgcctttaactattacacttagtgaagcagaagtgctctgctacagacttcgcaagctattggaggaaatcaagtgagagactatatcatcgggcttggacaatttgtttatcataaggtgaaaagtcaaaaaggcacgctgaaaaaccggctcgtaaacggctattctccgggaggcgacgcccaatttaacatagacgccgctgctgaggaggcggtgctggattatattcaagataagggccatccggttgctttttacacggaggatggcggcctgaagctgattggagaagatccgcaatatattttaattgtagatccgatagacggaacgcgtccggccgccgcggggcttgaaatgtcgtgtatttcgattgcgcttgcttcgtataagccaaacgcaaagattaaggatatcgaatttgcttttttgcttgaattgaaatcgggcgcttacatgtacggtgatatttacagcgacgccattcagtttgaggggtatcagggagaattgccgaatttgagcgaagtgcgggatattaaaaatatgttttggagccttgagtttaacgggcatccggcacagctgatgacggatgcatacggtcatctgattgaccggtcagccaataatggcggggtttttgttttcaacagcgcttcttattcgatttcacgaattatcacggggcagatggatgcttatgtggatatcggcaatcgtctgctgaaagatgatccgaagctgctttcagattttcagcaggtcggaaacggagaggtgctgcatttgtttccttatgatattgccgcaagcgtctttttggcgaagaaagcaggagtggtcattacggatgcatacggccggtctttggacgaaacgcttctgacagatttaagttatcagaaccagcaatcatgtattgcggcatcaacgaaggagcttcatcaaacattgttagaccaaatccgctggggcagaaaggaagagaaatatgaaggcgttggtctggactcctaatgataagcttgaatatcaagaggtggacgagcctcaaattcggaaatccaatgatgtgaaagtgaaaattttcggcaccggtatctgcggaacggatttaaatgtgctgaaaggaaaaatgaatgcaacccatcatatgattatggggcatgaatcggtgggagcggtcgtggaaatcggaccggacgtgacaaatgtaaaagtcggagaccgcgtcgtgattgatcctacgcagttttgcgggaaatgtcattattgccggagagggctgacgtgttattgcgaaaccttcgaggattggcagctcggaatcggggcgcacggaacgtttgcggaatattacgtcggagaagacaggttcatgtacagaattccggattcaatggaatgggagcgggccacattggttgagcctctctcctgtgtgctgaatgttgtggataaagcttcgattcagccggaggactcggtcttggttttggggtccggaccgatcggactgcttgtgcaaatgatggtgaaaaaactggcgcgattgacggttgcgactgaaataggcagtttccgaagcgaggcggcgagccggatatcggattatgtctaccaccctgaagcattaaccgtggatgaagtgaaacggattaatcaaggaagaaaatttgatgtaatttttgacgcgatcggcaatcagcttgattgggcttatccttttattgaaaagggaggcagaatcgtgccgatgggctttgatgatacgtatgagatgacagtcaggccgtaccagctgctgtcaaacggcgtaacgattgtgggcacaggtgaagcccgtcagatcatggaggctgcgttagcatgtgcatccgaccttccgcagctctatgattttattacggaaaagacggaactgaagaattatgaagaagccattgatcatctcatgggcatcgacccggtgacaaaagaaagaaaggatatcagcgcaataaaaacgattcttgtgtctgatccggaacttttataaaagcggaaacggctccagtgagagccgttttcttttcttttttatacggtcttgcacatttctttaaagtttaatatgatactctttgttaaccattcctttcctcaagacattatactctgagcgtgtccccttttccccgtaagcttgcctcatattccccagataaaaatcaatgtttccaactgataaggtgcggatttttatagtgaaaaggagtcgttatcatttgaaagattatacgttacagcagcaatggttcgggaatgtacgtaaagacattctggccggtattctggttgctctcgctctgatccctgaggcgatcggattttcaattattgcaggtgtcgatccgatggtcgggctttatgcatcattttgtatcgcgattattatttctatcttcggcggcagaccgggaatgatttcagccgctacgggttcaatggcggttgtcatggtgacattggtggctgattacgggctgcagtatttgattgcggcaaccattttgacaggtattattcaatttattcttggtgtcagtaagatagcgaaattgatgaaatttattccgcgttcggtcatgatcggatttgtgaatgctttggcgatcttgattttttctgcgcagctgccgcagttcaaaggagcttcatgggtcatgtacgccatgcttgccggatcactggctatcatatatcttttgccgaaggttacgacggctgtaccgtctccgctggtggcgattattgtcatgacgatcattgcggtggtcttccatgcggatgtccgcacggtcggtgatatgggcgggattacaagttcacttccgcatttcttgataccggatgttccgtggacgtttgagacattgcggattattttcccgtattcactggcgcttgcattcgtcggattgcttgagtcgttgctgacggcccagatcattgacgaaatgacggatacggatagtgataagaacaaagaaagccgcggacaaggcatcgccaatattgtgaacgggtttttcggaggcatggccggatgcgccatgatcggccagtctgtcattaatacgaaagccggcggtcgcggccggttgtcggcttttacggccggagcgtttttaatgtttttaattgccgtattaagcggtatcgtcgtgaaaattccgatggctgcgcttgtggccgtgatggttatggtgtccatcggcacgttcgactggtcatcgattaaaggtttgcggaaagcgccccttactgattcgatcgttatggtgattaccgtcgtgacagtcgttctgacaaatgatttatcgaagggtgttttcgcgggtgtgctgctaagcgcgatcttttttacggcgaaaatttctaagctgaagattgtgtcacattccgaacaaaaagatgtcagaacttataaggtcacgggccagatcttttttgcttccgtgtctgaactgatgaatgccatcgtttatgatgaagacgtgaaacggattatcattgatttgaccgatgcccacgtgtgggatgattctggagcggctgctcttgagaagattgtcgccaaatgtaaagaatacgaaattgaggctgaattaaagggattaaatcagaaaagccgagatttaatgaaacaaatggcatagaatttgtgaagtccggatgaatatatccgggctttttttcggttaaatttgccggtgtgcattgttataatgaatgagacttgaaaaccgtatataggagacttgcatatgatgtggcttcaaaagttgaaccaagtgttggggagaatcatgccgcttttgactccgtctagtgtggcggcgggtgtgctgttatctcagcatatcagctggatggccggcgctgtgccgtggatatttgcatttattacatttacgggcagtctgagtgccaattttcaatcgctgaagcgcagtatcgagaagccgctcccgatgatcatggcattgtttgttctgcatattttcatgcctgtttttgcatggggaagcggccatctgattttcagcggtgaccctttaactgtgacggggctgattatgggtgtggtgattccgaccggaattacgagtttgatttgggctgcgatgtataagggaaatgtcggattgacgctgtctattatcctggttgataccgtgctttctccttttatcgtaccattaagcctgtctgtcctggccggggcgaatgttcagatggatgtgtggggcatgatgaaagggctggcggagatggtggtgattccgtccatcgcagggatgatggtcaaccagttttccccgccggtaaggactcaggcgataagccggtcactgtctcctttttcaaaaatctgtctgatgattgtcattgccattaacagttcggaaatcgcgccgtatgtcacgcacgtggatatcaaatttgcgggcatcgcaggcacggtattttttattgccatgacgggttatgccgtggcttggctgatcggaagactgatgaagcggagccaggatgaaatcgtgtctctgatttatacagggggcatgcgcaatatcagcgccggagccgttctcgccgtgtctttctttccgtctcaagtggcggttccggtcgtcatcgggatgctctttcagcaaatccttgccgctttgttcggctatttgctgagacgctttgagcttaagccggtcgtgatcaagtatgaaaaaaaccgctcagtcacgtgagcggttttttccgtacagccagcttagtgctgaattaaattgtcgtttgaacgcttcttgatggtgcacggcgccctcttcgacagtgaaagagagctgagattgagaaaagcctttttgcctcaggctttcatgcacttctttattttgtccgatcatggtgtgttggatgttacatttttgctctgcttcacggctgccgacagacataaagatacgctgccgtgccggccgcaaaggtgcggagcggacataatctgctgatttttcataccagaaggaaccggaaatacagccgattctgccgaatatttcaggcttttgcagcatcgcgtatatcgaaaacagtccgcctaatgacgcaccgatcagtcctctcgtttccggatgcgcagaaatgtgatgcgtatcttcaacagtgggaataatgacatttgtcagctcctcgagaaagagcctccctttgccgccgaaatcatgaaacgcagggctcagggaaggcgcgggccacggtgtgtactcatcgagtctgtcagccggtttgatgccgatgaaaatcaattcgggaagtgttccgttcgtaaattgggattcaagcttatctatctgttctaaaaacaaagaacccccgtcaagtacgtacacacagggtaaagcccctgtttgaaccgaataggaaggaggaagatacacagtgcattcccttccgtttatcgggtgttctgtaagggtgcctctcatgcgtccatcccctttttttgcttaaacagaagaaaaaagaaataaggaacgccgagaattgcaaggataattccagccggcacttctgaaggctgaaagaacaatttgcccgcaaagtcggcggatatgacgaggagcataccgaccagtccgctgaccggtaatgagtatctgtgctcaatcccggcgagcctgcgggaaatatggggcgcgatcagtccgacaaatgccatgctgcccgctgcggttacacatgcgctgatcaaagcgatgcaggcaatgagtaaaatggttttttctttattggttgaaacaccgaggcttttcaccgtgtcctcatcgaaacgaatggtatccagcaatgacgttttcgccataagaagaggaatgaacaagatcagccacggaaggattgccgtaatggtcatccagtttgccgaccagatgctgccgtttttccaaaccatcgccatctcataatcctgcgggtccatttttaatgatagaaataaagacagcgcgctgaatccggaattcatggcgatcccgacgagaataattctgcccgattccagatgcccccggtgccaggcgaaaatatagatcagcacggccgccatcagtcctccgatgaggccgaagacaggcatacccatcgcagaggcaagtgccgtcgcttcagattgtccctgaaacagaagcataaacgtgacgattcccgctccggctcctgcattaatgcccaaaataccgggatcggcaagaccgtttttggtaatggcctgaataacagctccggctatccccaatccgagtccgatggcagcagccatgactatgcgcggcagcctcagctgaaacagcaaaatgtcatattgcggattcggatggatgcggaaaagcgtactgagcagttcacccggctttgcggaaaaagaaccgcttgtcatgctgaaatagcttacgagcaatatgagagcaatcagaatgatataaattcctgccattttacgcaccacgctgatcccctccttttcttttaatcaaataaagaaagaaaggaacaccgatgatagaagtgacaacttcaataggcgtttcaaacggataattgatgaatcggctcgcaaggtcgcaaagggtcagaaagacgccgccgataatgcacgcgcatgggatcagcctgctgtagtccgatccgacgagaaaacgtgtgatgtgcggaacaactaaaccgacaaaggcaatttttccggcgagcgccaccgagcttccggtcaatatgacaacagccgccatcgccatgagtttgatggttcttttctgctgtcccagactttttgaaatgtcgtctcctaatgatacggcagtgacctttttgctgagaatcatggccgtaatgattccgatcgcaaaaaacgggacggccagtttcaaaaaatcagggttcatttgatgcagtctcgcactgtaccaaaaactgagatcctgcgaaatttgaaaataaatcgaaagcgcagccgacagactgctgagaagcatactggtcaccgttccgataatggcaagctgcaccggggtaaaaccgccgggaagaatggaggccagcccgaaaacaagagcggcgccgaatgcggaaccgataaacgagtagatgatcatttcaatggatgtcgattgagggagcaataccatgcaaagggtgatgataaaagcggagccgtccgacacacccatgatcgaaggcgaggccagatagttccgtgtgattccctgcatgagcgctccggaaacagcaagggcggcgccgataaacatagcgccggcagccctcgggattcttgaatgccatatgatctgatggtcggtattctccggattaaagtgcagcaatgcggagaacacggtatggatgtcaagctgctttgcgccgtataaaacggaaaggagcagtgacagaacaatggcaatcggtgaagcaatgataataatgtgtgtccgccgttttgcatacatgtgaaaaacctactctttattagtcttgagtcaatttgtcagcagcaacctgtaagaagctgattttactccacgcggttccgccttgggctaatggatcaatcgtattgacgtatacatggtcttttttgactgccttcaggctctgccagatcggatttttctctaagtctttcaaagcgtccggcttatctgcgttttcgtcatcagaaaattgtacgaagatatggtcagggttcatttcgcttaatttttcaagagaaatcagttcctgcgctttcgccgctttgacttcgtccggcgccttcaggcctaaatcaccgtaaagcgtggagttgaaataaacttgctcaggataaatataaatattgccttgtctgattctgataaccagcgcgtttgactgtttcgctttgctgttgatctttgtttttgtctttttcaggtcctgttcgtaatctgcgatgatttttttcgcttttttctctttatctgtaagctgggcgagcagcatcatgttttctttccagtttgatgagatatgagagacagggatcgtttcagcggtgccgctcaattttttcaacgttttttccgggaatttggttgatgccagaatgacgtccggctgcagctcaagaattttttccatattcggctgcattttttcccccgtggatacggatttatctgtaatatctttaaacagttccgggaatttgccggagaaagaaattgctcctgccggatgaacgtcaagcaatttggcgtcttccattgattctacgctgcctgtaatggcgattttgtcagtcggcgctttgacttcatatgtttttccgagatattcgattttctttttatctgaagaagcgtcctttcctttacttgctgtatcagatgtttctgagcttccgcaagccgcggccgtgaaagccaaaagcaaaatcatgaaagcgaatgccaatttcttcatctattgttcctcctgttcaattgataactattatcaattggaattatagagaatgaatagggataagaccatggataatttccggcattaccatggacgatcttcggataaaatggaaatgctttgctcgatcatccgctgatgtccgcttggagaatattcaatccacgggtcagatgaaatgggaaacacgcgtttattgctgacggcactaaggttctgccatatcccggactgctgaatccgctgaaaatagcgaagcgtttccggttctttacaagtgaaaagcatgatgcagtcagcctggcaatccgccagcatttccaaggaaatcttttcgtcaggagcaaaagattccggttttgcggaggcaaagtccaaatcaccgaagaagacttcctcaatactgttgttatgggcgatgtacatattttctttatatacacggacaaataagaaccgctggtgccgcacatgtttaagagcatctttcgctgaatgggtgagactttgataagttttaagccagtgccgcgcttcctgctcttcattcagatatgcggctgtgcgaagaaactggtctctccaattctcttgagccggaagataaaaaacttcagtgatgtcattcaggcgctgtttttcttcttcactgacagaatcgagactgaaaataatgtccggggcagcttgagacagcgtatgcaggttctcttcccaatttgcattatagcggtaagcgctcaggtgaaccggaatatcggaagagaattgtttgtaataataggccgtccatttcgggtgcagcgccgcagcgtaaggcacgtgatgcagaggaatcagatgccccatcgtttcttttccgtacgcggccatttttgtgcgcctttttttcatatagcttgtaggtgagctgccggtatgttttttaaagatgcggctgaaataaaattcgtcctggtagccgatttgatgagcgatttcccgcagtttgcagcttgccttggccatcagttttttcgcattggttatgcggatgtctgtgatgtattcagttacgctctgcccgtatagttttttaaaggtttcactgtaatgcttgggactgattcccgccatatgagcgagctgggtgagcgtgatttttgtgtcggactgagcatgtatgaattgttttgtctgttcgatcgccgctttcgtattattttgatggcatacttttgcggcataaaggtcgtacatcagctgctgaaagtcggctgtatatttcattttctgcaatccatccgccgatcgcacgttttcagaaagtgattgaagccggcttgtcaaatgatcaaccgtttgtaaattcatttgctgaagtccgtggaagatgtcttccccgttatccggaagcatcgcttcatcatctgaggaataggagaaaacacggagtctgacgatatacaaatggatgccgcctgacgatataggggcaatattgaatgtctcatcacaaggacagatgtagagcgtttccttctgcagcggaaagctgtctgttccgatatcaatttgtccctcgcctttcacatgaaagatcaatacgggggaatcagtgagctgatgctctgacagaaggtcggctgttttttttacggagatgatatcaatgggctgaaagaataatgtgtttttcatgagaaaccaccttttaggaaacattcatttaaatgataactgttatcaattaaattgtaccaaataaatgaatgttttcctataaaaagcggaaatgtgaaatgcgtcaaaatgttacacgtgtaacacgaatgttgtcagtatatgaggtattgttttcttagagttttgaattggtccagccggcgttgatatgtgccggtgatgtcttcaatggaagcgcctttttctatttttttgcgtacccagccgttaccgatcagcttgtcaaaagagcctgtcggcaagaatgaaaagtcattcggatataagtcatgcatggttttcagaatggagagccctgtttttgccgcttcaaatgtgtttctgtttgttacgtagacttgtacgccgtggcacagcttgccctggtgcttggagaagctggggatgaatgaagcggctctgaaggtgacgcccggaagcttgagactgttcaggcgttcttcgagctcggtgcttttcatataaggcgcgccgataagttcaaacggctttgtcgtgccccttccttcggacacgtttgtgccttcgattagtcctgttgccgaatatgcgaatatgctgtccggggtcgggatattaggcgaagggaggacgaacggcagaccggtatcttcaatcgtcatcgtccgcttccagcgcttcatttttacgacggtgaggtcggcgccaatatgaaactctttattgaataaaagagcaagctcaccgatcgtcatgccgtgcttcagcgggatcggatacagtccgacaaatgaagcgtaatccggttcaagaaccgggccgtccggatttcgtccgccttgcggattcggccggtccaagacataaaaaggaatgcctttttctttggccgcttccatggcataggccattgtataaatgtaggtgtagtaccgggttccgacatcctgaatatcgaaaatcagcacatctgtatctttcagcatgtcaggcgtcggtttcctcgtctccccgtataggctgtagacgggaagccctgttttttcgtctatataggatgtgactttgtctccggcctgagcatcgccgcggacaccgtgctccggtccgaataatgccgtcaggcggatgtctggcgcctcatacagcacgtcaacgctgcttttcaatgatgcgttcacaccggtcgggttggtgatcagcccgactctttttcccttcagttcctgtttataatctttcagcaggcggtcgatgcctgtttggatgcttggtttcttggcggtatgaaggtttctgtcagaagccgccgagactgccgtcatagcactgatgacgacaagtccggcgagaagtgcagccgtatgtgttttcataatcagccctcctgtttaaagcggttttccggtcttcagattgataccgaaaccataaggatacagtgtcgttcccggatgcgtgacggaaggaatgtcagcgggcagcctgccttgcggtgttgtctgtccgaatatcgcttcaatgcctgccggaatgtttggctggaggaattgtccgtctgtatatcctttaaagccgtagactgcgataagggcttcagcttcttcaaaattcgcggcgtcgtaaggattacgcaggctcatcagcacaaagggtttttggttcgattgtgcggctttcatgacggcccgcggaaatgcggtcgtccacttgccgggatctgtgacggaatcgtcaatcacgccgtcgtttacgacagggtcattttttacgacataggagcctgtaatcacgtaatccgcgtcggataccagctttttgtgttcatcatgaaatgtgcgctcggcgaagttcattttactgatggttaccggccggatttttttcttcttgatgagctgccgaatggtttgttccattgccgctgtttgatcttcataaggagcggcaatgagaacgcggctgttctttttcggtttgaatgggagcgtgcggtttttgttttgtaagacggtgacggatctttccgcgatttgtttttcagctttcaggtgatttgtgctgccgacggttttctttgcttttgcaatcttctttttcagatttgtctctttcggtgcgggatatatccctcgttttattttcagggaaatgatgcgttccgctgatttgttaatttgctgcagcggaatatcccctttttgtaccgccttttttaaagcggaatgaacccgggcaaagcggttttccgtttgcagcgatgtcacttgggccggcatcagggcaatatcgactcctgcttttactgccatgacgaccgcctcttcctgaccgaaatgatcggcaatggctttcatatttaatgcatccgtaacgatgacgccgttaaatcccatttcctcacggagaagatgagtcatcacttttttcgagagtgtggcgggtacgaggatgtctgaaccgtccagcttgcttttataggttgtatcgtcaaaagcgggaaattgcacatgagctgtcatgatcatatcagctccggcctgaatggcctgccggaacggataaagttcaatctgacgcagcctttcttgattgtgggtgacaagcggaagaccgtagtggctgtcgacatcagtgtcgccgtgtcccgggaaatgtttgacggcggcagcgacattctgcttttgctgagccttcattgaggcaagaccgagtgaagctgtcagatcacggtctgaactgaacgacctgacgccgatgacagggtttccgggattattattgatatcgagaacgggagcgaaattcgtattaatgcccagtgctttcagttctttcccgataatggcgccggtctgggacgcgtaggctgtttttctagcagccccgagtgccatattgcctgggaaatgagtgccctcaccaagtctagttacgatgccgccctcctgatcaatgcttaataatagcggaatgtcagggctcgccttttgaaaggcatctgtcaggcgtaccgtttgctcagtgttttttgcattttctgcaaataagataacgccgccgaaccggtacttttgaataagccctgcgacttcgtcattcatttgggtaagagcctcaggtgatgactgcccctttttttgccaatttcgaaaatcaggcatgagcatctgccctaatttttcatctaatgtcatacgggataccgcttgttccgcctgtgacggaatgtccggttttgttgatgcatgatgcgtgccgaatacaatgaacaacagtaatacagctgagatgaaaagtttcatgatggtgccctcctgccgtcatagtttggacaaaagacatgggttgtcattcaatggcttcataaatcgcttttatgacgctgccgtagcttccggtcgggaaaagatccccttcaaaaacattcgggttttcaccggggctgacgacgggggaatgctttttattggtcaaaagtgcgatccccagcttataagcgggatcaataatcgtgatggtgccggtccatcccgtatggccgtatgcctgcctgcttgcataaggtccgaacatccactccatatccgggctgccgtttttccgccagccgagagcgaaagtcggatcagaggatgccgccgttgtgaacaaatcggccgttcttttattgaagagagaaacgtgtttataactgcctctgttcagcatgacttgaagaaggacggccatatcatcagctctggaaaacagcccggcgtgaccggacacccctcccattgagtaaaatgctttttcatcgtgaacttccccctgcagcgtatatgtcctgatgtgagggaaatggatgactccgtcacgtgtgttgcctaaacgttcagtagctgcgaatgctttttctttaaaacctttttgcagcggattgaacagtgtgtgcgtcagtttcagcggtttgtacagttcttgttccgcataggtatcaagggtttttccggttatgttttcaatgatgcatccgagaatcatgtaaccgatatcgctgtatacgtgttttgttcccggcttgtattcaagcgggatctgggtgagaaaacggattgttttatcccgttcttgtgaatataaagggcctgcggtgtccggctgatagaaataaaagcttgccggcagaccggattgatgctggagcacatcgatgacgcgtatacggtctttttcttgaatcggatcgctttttctgtctttgaaatcaggaaggtaagccgagactttttgatacacatcaagctttccctggctgacgagtcgctgtagtgcaaaattggccgcgtacatttttgtattggaagctaaatcaaacatggttgatgttttcatttttttcggacgggataaaagggtgttcccgtcatattttttgctgtagccgtatgctttctttttgatcacccgtccgtcctttacgacgatgaggacggctccggggaatcctgctgcgatgtctttttcaatcatttgatcaacctttctgagctttgctgcgtcgtataatttggattgggcttcggctttgtgctgcggcagaaaagagaggctgatgaccattgtgagtatggcggctgtcagtgttttcatattctgatccctcccggtttattcaaattcagcagccatgtcatccttaaatccgaacgcataagtgaagacaaagcctgccgcgtaagagatgaagagaccgatgatatacaaaacgatttgagccggctgtacgagaaacgagagcggaaggccggagacaccgattgaaaaagtcgccacttgaaaatgggcttgaaaggcgccgccgattcccgcccctaaacacgccgtcaaaaacggccggccgagcgggagcgtgacgccgaagataagcggctccccgattccgagcagaccggatggaagtccgccgccgatcgctctttttaatgaggctttttttgttttcataaagatggcgaaggccgcgcctacttgacccgcgcctcccatcgcgagaatcggaagaagcgggtcatctccgattgatcggattaattccaaatgtacgggagtcaagccctgatgcaggccggtgacgacaagcggcaggaaggcggctcccagtacaaaccctgagagcactcccccgatattcagcagcgacaataaacctgatgtaatcagatcagaaataaaaccgcctgcggggataaaaacgacatatgtcaccagcccggtgataagtaaagacaatgtaggcgtgacgataatgtcgatggattgatggacgtgctttctgataaaccgttcggtataagcgataaaaaccgccgcgaaaagaacgccgattaatcctcccctgccagggagcagattctctccgaacaaactgatattggcgatctcagggttaaggatcaatatgcccgcaaggccgcccatcgcgggtgtcccgccgaattccttcgccgcattgatgccgacaaggacgccgaggtaagcgaacaagcctgaaccgataaccgttaaaataagtgcgatttgggattctttcgggagccagccggcctgaatgacggctttcgtaataccggtgattaaacctgatgcaatgagtgcaggaataaggggaatgaagatgcttgatatttttctcagaaacaatttgatgggtgtggtgttttttctgttgagatcggcttttttccgtgaggcggcttcttttaaatcaatgttttttccggatggcataagttttgcgaaagcgtcggcgacatgattgacgacacccgtgccgagaatgatctgcagtgtttcggcttcgacgacgcctattaccccgccaagccgtttcagcgcctcaatatccgttttgtcccgatctaaaggtgtaatcctcaggcgtgtcatacagtgggtaaagcctgaaatattcgctgaaccgccgcaattgtccaggatatctttggccagtgactgataaaatgcctctttgctcatggagatcctcctttttccgtacgatttttcccggggagctatgcctgaaacgcgtcctaaaagcgcctgcgccgaacatgaaaacggcgcgggctcgtaaaagcacattatttttcaccaaagaacgatcagcgttctttttctcttgaaacgtgctgttcaatggctttatcaatgaatccttctgattctttgagcagtgccttcgcgtgtgtttcgtccgaattcgtcttcagcatgacgattgccgttttgacatggctgtctgcggcctcaagcgtttcttttgccttgtcgtacggaacgcccgtgatgctttggataatgccgattgcgcgttctttcaatttttcgttgctgacatgaacgtccaccattaaattttcgtacactttgccgcttttaatcatcacggccgtggaaatcatgttcagaatcattttatgtgccgtcgcggctttcattcgtgttgaccctgtaatcacttcggggccgacaatgacttcgatgctgtgatcggcaaaggtgctgatcaaggagtccttattgcatgtgagcgcgacggttttggcgccgattgtttttgcatatttcagcgcaccggccgcatacggcgtgcgcccgcttgccgcgatggcgatcacggtgtcttctgcggtaagcccgatcgttttgagatcgagagcgccggtttcctcgctgtcttctataccttcagccgcttgcaaaaaggcgtctgcccctccggccatcagaccgatgacggtgtcgggacttacgctgtatgtaggcgggcattcaaccgcatccagtacaccgagtctgccgcttgtgcccgctcccgcataaatcagcctgccgtttcgccgtaaggactgatgggcgaattgaacggcaatctgaatatcgggcagcacctgctgaacggcttcagccactttgaaatcctcttcgttaatgatgcggagaatttccatcgtgtctgcctgatggattgaagcggtctgcggatttctggtttctgtggtcaatctgtgaatgttaagccggtctgtcatgattgtaccctcccaagtcgttaatacttgaagtatatgggcttctgaatagatgtttcaagaaaaatcggcagggatgagttgaataatcaagcgctttcacaaaaaatgatgcagaatgtgctgttcaccgatcggaccgatcctgcgccgccctttgtcaataaaaccggaagaccggtacaggttctttgcacgttgattgcgatggtttacagcaagcacgatttcatcacaccaaggaaagtaatttgcgacaaaagcggggagctgcagcatcgcttgtttggcataaccttttccctgatgcggcgcatgtaatgacagcgcactcagcaaaatggcagacacattgttcgaatacggggcaatggtttcttttgaggtatgtaaaataaaaaaaccgacggggcggtcttcttttaaaatgactgtcgggtagcgatcccggatgacaagcgcctgcggcaggacatctatcggcagagctgtgaactttttatcttcttcactcagcacaaacccgttcagcccgtctgcatgctccggtttataaaaggacagggctacatccatgatatctactctccttttttataattgatccaattcatcttctgatagaacacggcagcctgcccgttttaaaagagcggaagtgatgccgtctccgagtattttttttcctgagaaagtgccgtcatagataaagctgctgccgcaggacggactgttttctttaaggatgaccgttgcggcgcctatttcttttgcgtatgctaacgttttttccgcgccgtccatatataaagctgtaacgtcttcgcctgatgccgttacgattcttgccgttccgttcagcacgtcttcacccgtgccgccgatgatttccgccggttcgcggggagtggtgaagccgcccaaaagttcggggcagaccataacagctttcttttcttctacgagtctgcggattttttccgaagcggcgtgagagccgttatatctgcattcgataccgccgagacaagagctgactaagatcatctgtgtccattcccttcaatattttgatactttcatcataaatgaaataagagaggagggatgagtttttcagttaaaaaacgggtaaaaaagtttgaaaataaaaaaaataatttttctctttacaaatggggtacaacctgtatataataacttttgtcagctcgacgcggacacaacggcccgttggtcaagcggttaagacaccgccctttcacggcggtaacacgggttcgaatcccgtacgggtcatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcactgttttccaaaaaaatacggaggggtagcgaagtggctaaacgcggcggactgtaaatccgctccctcagggttcggcagttcgaatctgcccccctccaccatttttgggctatagccaagcggtaaggcaacggactttgactccgtcatgcgttggttcgaatccagctagcccagtctcagacaccttttgcataaaggtgtctttttttatcggcattttgtttcgatttttgattgttcatcagatatactatttttaagctgctgttaaggcagtatattctgtattttccatctacaccctgcctgaaatttggtaaaataaatgtaataaaaaaatgaaaccttttaaaacaatcaacgtatagatacagaccggtgaagggcagaggtaagataaaacatggaaaacctgattaaaaaaagaatcaagcaagtcaaaaaaggcgatcaaaatgcgtttgcagaaatcgttgacctttataaagataagatttaccagctttgctaccgcatgctcggcaatgttcacgaagcggaagatattgcgcaggaagcttttatcagagcgtatgtcaatatcgacagtttcgatatcaacagaaagttttcaacgtggctttacagaattgcgaccaacctgaccattgaccgcatccgcaagaaaaagcctgattactatctggacgcagaagtagcgggagcagaagggctgacgatgtattcgcagatcgccgcggacggggttctccctgaagacgccgtattgtcattggagctgtcggacacaattcagaaaaagattttaaagctgcctgacaagtacagaacggttattgtattaaagtatattgacgaactctctttaattgaaatcggggagattctgaatatccctgtcggcaccgtaaagacaaggatacacagaggcagagaggctcttagaaaacaattgagggatctttaagtggggtgatgaaatgagctgtcctgaacagattgtgcagcttatgcataagcatcttgatggagatatccttcctgaagatgaaaacgtattaaaacaacatttgcagtcatgcgggaattgcaaacggcattttcatgaaatggagaaatccgtagcactcgtccgaagcacatcgcatgtcacggcccctgctgattttactgccaaagttatggcgaatcttccaaaagagaaaaaacgcgcttctgtaaaacgatggatcaaaactcatccgatgattgcagccgcagcggtttttgtgattttaatgggcggcggttttttcaacagctggcataatgaccacaatttcagtgtgtccaaacagccgaaccttgtcgtgcagaatcacacggtcaccgtccctgaaggcgagaccgtaaagggcgatgtcacagtaaaaaacggcaagctgttcattgaaggaaaagtcgacggcaatgtgaccgtcgtcaacggagaaaaatacatggcctcagccggacaagtcaccgggcagattgaagagattaaccaattgtttgactgggtctggtacgaactgaaatcggcgggacagggcgtcgtaagcgctttggacccgaatgaagatgagtaaagcgtataatcgctttactctttttttgtgcaacgccgcgccggctcatttcacttgagaaatcaaaatgtggtataatgagcacgctatatgatgtacatattgctcatgcagcacaattcataacggaaaaaacgaaatgactgaattcttggaggacgaggaaatggcttttgaggacatcccatttttgcaatacctcggcaatgccgttgatattctccttgtttggtatgtgatatataaattaatcatggtcatacgcgggacgaaggcggttcagcttttaaaaggaatcgtcgtcatcgtattggtccggatggccagttcatatttgggactcagcacgcttcagtggctgatggaccaagcgataacatggggatttttagcgatcatcattatattccagcctgagctgagacgggcgcttgaacagctcggacggggccggttcttttccaggagcggaacccctgtggaggaagcgcagcataagacaattgaagcgattacaaaatcgatcagctacatggcgaaacgccgcatcggcgcactcatcgccattgagcgcgatacgggaatgggcgattatattgagacgggcatcccgcttaatgcgcaggtcagctcggagcttttgattaatatcttcatccccaatacaccgctgcatgatggagcggtcattatgaaaaataacgagattgctgcggctgcctgttatctgccgctttctgaaagcccgtttatttcaaaggagctggggacgcgtcacagagcggctgtcggcatcagtgaagtgacggacagcttaaccattattgtatctgaagagacgggcgccatcagtgtggccaaaaacggagaccttcacagagaattgacggaagaagcactgaaagaaatgcttgaagccgagtttaagaagaacgccagagacacttcttctaaccgctggtactggaggggcaagaaaaatggataaattcttaaacaaccgctgggctgtaaagatcattgcattgctcttggcgctgctgctttacgttgcggttaacaacaaccaggcgccgactccgaaaaagccgggggaatccttttttccgacatcaacgactgacgaggctacgcttactgatattcctgtaaaagcatactacgatgaagcgaactatgtcgtcaccggcgtgccccagacggtaaatgtcacgattaaaggctcgacaagcgcggtgaaaaaagcgagacagacgaagaattttgagatatacgccgatatgaataagctgaagaccgggactcataaggtcgaattgaaggcgaaaaacgtatcggacggactgacgatctccataaacccgtcagtcacgacggttacgattcaggaaaaaacggctgagagttttcccgtggaagttgaatactacaataaaagcaaaatgaaaaagggatatacccctcagcagccgattatcagcccgaaaaacgtgcagattacaggttcgaaaaatgtgattgataacatttcacttgtcaaagcatccgtgaaccttgaaaatgcaaatgagaccattgaaaaggaagtgaaggtgaccgtctatgacaaagacggcaacgcacttcctgttgatgttgaaccgtcagtcattaaagtgacggttcccgtagccagtccgagcaaaaagcttcctttcaaaatcgaaaggaagggaagtcttccggacggggtgagtgttgcgagtattgactcgaatccgagtgaggtgacggtttacggcccgcaggatgtgctggattcactggaatttattgacggcgtatctcttgatttaggcaaaattcataaagataccgatatcaatgccgatatcccgcttcctaagggcgtcactaaggtatcaccggaaaaaatcacgcttcatgttaaagtggacagtgaagacaaaaaggattttgacaatgtcgcaatcaagacggtcggactgggaggctcacagcagattgagtttctcgaccctgaatcgcaggcgataaatattacggccaaaggctctcccgccaacattaaggcgctgaaaaagtcggacattgaactgtatgccaatgtctcggacttggatgacggagagcactctgtaaagcttgaagtaaacggcccgcaaaacgtcacatggtccctgtcaaaagacacggttaagatcaagctgacttctaacaaaaacacaagttcaaataaaaatgacggcggctccgctgattccggcaataagaacggcacaagcggagacgcagacaaagacaagagcaagaaccgggaagacgacactgacagcgatcagaataaaagtcaaaaccaggatcaaaatcaagaccaggatgaagacggatcaagcgctgattcttcttcaacagaatgaaaaaggagcgatacaaaatgggcaagtattttggaacagatggtgtaagaggtgttgccaacagcgagcttacgccagagctggcctttaaagtggggcgttttggcggttatgtcctgaccaaagataagcagcgcccgaaagtgctgatcggccgtgatacacgtatctccggacatatgctggagggagcccttgtcgccggacttttatcgatcggagctgaagtgatgcgcctcggcgttatttctacgccgggggtatcctatttaacgaaagccatggatgctgaggcgggcgtcatgatctccgcttctcacaaccccgtacaggataacggaattaaatttttcggaggggacggctttaagctttctgatgagcaggaggccgagattgaacgtctcatggaggaaccggaagataagctgccgagaccgacaggcgcggacctcgggcttgtgaacgattattttgaaggcgttcaaaagtatctgcaatttttaaaacagacggcggacgaagattttacgggcattcatgtagcgcttgactgcgcccatggtgcgacatcttctattgcgacgcacctttttgccgatctcgatgctgacgtatctacaatggggacgtctccgaacggattaaacattaatgatggcgtcggttctacacacccggaagcgctgagtgctttcgtcaaagaaaaaaacgccgatatcggccttgcgtttgacggcgacggcgaccgcctcattgccgttgatgaaaaaggaaacatcgtcgacggcgatcagatcatgtacatatgcgcgaagtatttgaaatcagaaggccgtctgaaggatgataccgtcgtatcgaccgtgatgagcaacctcggtttctacaaagcgcttgaaaaagaagaaatcaaaagcgttcaaacggcagtcggcgaccgctatgtcgtagaagcgatgaaaaaagacggctataatgtcggcggagagcagtcagggcaccttattttccttgattacaacactaccggcgacggtcttttgtccgcgatcatgcttgtgaatacgctgaaggcgtccggcaaaaccctttcagaacttgcggatgaaatgaaaaaattcccgcagctcttagtgaacgtgaaagtgacggataaatataaggtagaagaaaacgctaaggtgaaggccgtgatttctgaagtggaaaaagaaatgaacggagacggccggattttagtgcgcccgtcaggcaccgaaccgctcgtacgcgtgatggcggaagcgagaacaaaagagctttgtgacgaatatgtcacaaaaatcgtggatgtcgtgcggacagaaatgggagcggagtagcgaagtttataagcagagagcgaacaagacaagtgcgatcagcataaaatgatagtaaacatgatgccggggcggcaaaaaataattgaccgtccttggcacatgctgtaaaatcaagcttgttcagcctttgtttttcacttgcaggaaaggcgggattgtttgcatcttttataattacagcgcccgaactaagcgcccgaaaaacggcttagttgacgaggatggaggttatcgaattttcggcggatgcctcccggctgattcatttagatcacagccgtaaggatttcttcaaaccggaggggcgactctccgaacaaagggaaatcacatgatcttccaaaaaaacatgtgggaggggacgattgaaagtccccttgtaatttgactttcttcgtctccttttacacctttaggaggaagaaaatatgtgtggaattgtaggttacatcggtcagcttgatgcgaaagagattttgttaaaaggattagagaagcttgagtaccgcggctatgactctgccggtatcgctgtggcgaatgagcagggcgtgcatgtgtacaaagaaaaaggccgcatcgccgaccttcgtgaagtggtggatcacacggttgaatctcaagcgggaatcggccatacacgctgggcgactcacggcgaaccaagcttcctgaacgctcacccgcatcaaagcgcactcggccgctttacacttgttcacaacggtgtgatcgagaactatgttcagctgaagcgcgaatatcttgaaaacgttgaactgaaaagcgacacggacactgaagtagtcgttcaaatgatcgagcaatttgtggcgggaggactcagcacagaagaagcgttccgcaaaacactgactctgttaaaaggctcttacgcaattgcattatttgacggtgaaaacacagacaccatttacgttgcaaaaaacaaaagccctctgttaatcggccttggagatacgtttaacgtcgtggcatctgacgcgatggctatgcttcaagtaacgaatgaatacgttgagcttttggacaaagaaatggtgatcgtgacaaaagacgaagccgtgattaaaaaccttgacggtgaagtcatgacacgtgcgtcttatatcgctgagcttgacgccagtgatatcgaaaaaggcacataccctcactacatgttaaaagaaacggatgagcagccgcttgttatgcgcaaaatcatccaaacgtatcaggacgaaaacggcagactggccgtggccggcgatgtcgctgacgccgtggcggaagcggaccgcatttatatcgtggcttgcggaacgagctaccatgccggtcttgtcgggaaacaatatattgaaatgtgggcaaacgtaccggttgaagtgcatgtagcgagtgaattctcttacaacatgccgcttctgtctaagaagccgctctttatcttcctttctcaaagcggagaaacagcggacagccgcgccgtgcttgttcaagtcaaagcgctgggtcacaaagcgctgacgattacaaacgttccgggatcaacgctttcccgtgaagcggattacacattgcttctgcacgcaggccctgagatcgcggttgcatcaacaaaagcgtatacggctcagattgccgtgcttgcgatccttgcgtccgttgcagcagaacgcaacggcgttgatatcggttttgatttagtcaaagaattaggtatcacggcaaacgccatggaagccctctgcgaccagaaggacgaaatggaaatgatcgcgcgtgagtacctgactgtttcaagaaacgctttcttcatcggccgcggccttgactacttcgtatgtgtcgaaggcgccctgaagctgaaagagatttcttacatccaggcggaaggcttcgccggcggcgagctgaagcatggaacaatcgctctgattgaagaaggaacaccggtctttgcgcttgcgacacaagaacacgtcaacctgagcatccgcggaaacgtgaaggaagtcgcagcccgcggcgccaacacttgcatcatctcgctgaaaggcttagaagacgcagacgacagattcatcctgccggaagtcaaccctgcgcttgctccgctggtatctgttgtgccattgcagctgatcgcttactacgctgcactgcatcgcgggtgtgacgttgataaaccgcgcaaccttgcgaagagtgttacggtggaataatatatttaacccctttggttattagccagaggggttttttaatgcggaaatgagaaatgcatactctttgcgattgtaaagaaatccccttttatatattgaaaaggagtaacacctgctttataatacgagatgcattccggttaacatccataaatgtaatcattagtaaatcattttgtgtatacctcatcggaaagtaaacacctcagcagttttcatcatgaatatcccattatataaacctaatcaatcgattacacttccatattatgcttaagactttaaaatcccttttgtatttcccgactcctgatccattatgaatacctagaccagatatgaaaatcacaacatttttgcaataatccggttcaattcttaaaaaagtcctgacaacaatgataggagtggaatgatgtcaaaccttttagaaatcagaaacatcagcaaatcttttggtcataaagctgttttaaaggatgttacattcaatgtgcctgccggatcaattgtcggttttatcggtgataacggcgcaggcaagtcaacaacatttaaaacgatattaggattaatttctcaggatagaggtaaagtgaaaatctttggtaaagagaatctggataaacatataaagtttaaagaagatattggggtcgtatttgatgcgatgaatcttcccgcgcaccttacgataaagcagctgaatcatgtatttaagaaactgttcggtgcttgggaccaagatcaattttaccagttggttcattctttctctttacctatggacaaaaaagtgaatacattctcgcgcggcatgtcaatgaagttatctgtagctgttgctttgtcgcataatgcaaaattattacttctggatgaagcaacgggagggcttgatccctcttcaagagatgacctgttaaatgaattaaaaagctttgtgagtaaaagcaacggaggtattttactttcatcgcacattatgactgatgtcgagaagatagccagccatatcattatgatgaaagatggcgaaattttattaaatgaagagaaagataaggttcttgaaagctataccgttatagacgttgatgaaggtcaattggctgagattgacgaagatatcgttctagcaaaaaggaatcatggatcttattggagtgtgcttgtatcggatcaacagaaattgccgaatggcgtaacggccaacaccatttccatagaagaaatcagcgtctttttaacgaggagtgaaaacattgagaggtctgttactgactaactattacttggtttatcggagtttctttgcatacacggggttggccatattggtatcagcagtcattttttattttggggatgcttcaatgcatcgttttgttgctatgctgattattttgtttgtcgttatgcccgcacttgaggttataaagtatgagagcaagtcaggctatgacaggtatgttctgactttaccggtcagcagaacaaatattgttcaaagtcactatttcttttatcttttgattgttgtgatcggagctgtaatatcttatggtattttccttgtatacagcctgggttctgatgaaccaattgacggtatatttaatattgtctcttttggaacgttcatcgttctctttgccggtgcaatcgtttatcctcttctctacatgataggcccggaaaaatccgatgctatcgtgattggaggggcaatggggggactttttgctacctttggattacaaagtgtcgttgggtatgcagcagaacaagtaccgctgtcatttttgcacataaatccttctttatatgtcccgattatatatctcatgatcggcgttatcttatatatcatttcatttttcatcgccgcagctatatatcataaaaaagaattttagcagctgtttaatgattttatgctgtgacaacaggataaggcatggcacgggctcatgattttactttaaatccaagcaggcagccgcccgcacaatgggcggctgttcttctaattaaaactgcgttgtcacatcgtactcataatcaatcttcaatttcacatttttcatagccgattttgctgttgcaagtgtgttgtatttaaaattccagatgcttgagactgagaggttatcttccagtgtgataccgtaatttccttgagtggagctgtttgcgagtgcgcggtgccacactttattttcttctgtcattatgcagtgtcttgtgtttccttgacttggtatttgagtcgcggcggtgctgattcttttcactatggcatcttttggaatgcttgtctgtttggttaagtcgagcctgagaacggttgaatctgatccgttcggactgaggcttgtatttcctttattttcagctgtgccgctgaatgcgaaggtctcgcttccggctttgattcgatcgtaaatggagagtgtaaagtatatatcgtcagtgtatgagccgcgggacacttttacgtagaacgtctcgttgttttctttcgcatctgtaatggcatagataaaaggaagcggcgtatcagggtttatcacttctgtgcctttactgatcagcactttgtttttattataaatttcaatgctcattcccttgtattcacttcttgttgagctcctgacatagagtctttctcccttatttgccgtgaaagtgaagtacgattctttttccccttccggcaatatggcagtatcaatatttttatatttccagtagcctaccggattggcagtttcaaatgagtgatttcctgtaatagcgcttatttgtgatgagttcttttgagacgcagaggctgaaggtgcaatcaatacgcctgataatacgattgcactgacaaatagtatagatatatactttttcatggaaaaatccccctttttgacaacatcatacataaaaactcccgtaatgtaaacatttgttattttagtttaaaatcaactggaaaacagccgatacaaatactagaacattatctcaagcggaggttaaaaacatgcgcctaaacgctcgttatataaaaaatcaagtaatggctcagcaagtgcttcagcggtattcttccaaaacaaatgtgaaagatgcggcaaaaggatcggacagcttattgattcagacaggcgggagccgcgatctgagccaggtgaattattcaaggagcggtgtcactgagaaagggagcagcctgtcccgtttatatcaatctgcaaatcagaaaacgattacggataatgggaatgagacggtaatagacgctaataatccgtatgagtctgagagtgatattgcgagcaagattcttgatgagaaatacagccgtatcaatgaaatcaataaacgaaaaccagttcctttgcattatattaaggataaataccagcatgccgattcaccttatttcagaagtgatttatcagaatcggagcgtcaggccgcttatcataatgaaacggaatggctgtttaaggggaaagcccagagctatgatttccgtgatgcggcgtttcggggtgaaacgctcaacggagagattcaagtcgaaaatgaaaaggtgtttcagcgggcgcaggtgaatcagcagattgagatgcttttccatcggaatcatattcagattccggagggtgcgaatcttacatttacgatatcaccgattgattatctgttaaaagtgagcgggactgacgataaagagctcactcagcagattgaagctgtcttaaactccggggaaaacagcaaagagctgtttgcgcacatcattcgcagccggagtgatgactcctcgcagtttacgccggaaacatatgagaaatatcaagtcgttcgggaaatgtacgaggtgaccggctatcatctgaaagacttgcagatcgtggacggaaagtacgtcacagaagacggacgcgaccttttagacgtctataaggaagcgctgcagcaagatcctttgttgagacatacggcggcagaagcggccgcccattacggacaggggctcacgaagcttgcgagaacgggttatgacgccattcctgatttggttctgtccattgagtataaaaacggatctctgcgtgatgccggtcaaagcaggcaatacggatctggggatacagattggctttctgaatggaaacgggagctgggtgtgcgtatataaaaatgagaaaaaagctgacaaatgatgccgtcagctttctttatgtcttttcttaaaactcctcatactccgccgggtcttggccgtttatccgtccgtcggggcgggtaagcgagtcgatgatgctcatgtcgttttcatcaagggagaaatcaaaaacagagatgttttcaagctggcgctcgggcgatgctgattttggaatcgggatggcgcccagctggatatgccagcgcaaaatgacttgagaaatggttttgccgtatttgtccgcaatctgtccgagtttttgatcgttcaatacttcgccggcgcgggataacggactccatgattctgtcacgatgccctgttcttcgtgccattggcgctgctgctgctgattaaaagcgggatgcagttcaatttggttgatgcctggctttacgccggtttcacgttcgagccgttcgatgtgctcaggcaggaaattgcagacgccgatggatcggatcaggccccattttttcgcatcaatcagtgcctgccatgcttccgtgtagcggtcttgtttcggattcggccaatggacgagatacaggtcatagtagtccagaccggcgcggtataaagattcttggatggtttgtacagctttgtcatagtcatggtagcgcccgggcagcttggacgtcacgtatagctgttctctcggaacagagcttctgcggatggcttctccgaccgccccttcattttcatagttataagcggtatcaatcagacggtagccgatatcaatggcgctggtaatggcatgaacgccattgtttccattaagagcgtatgtaccgaagccgatcgcgggaatgtttgtcccatccagcagtttcttttgcggaattgtcccagtcatcattaaatccctccttgttttctactttaccattattcttacaaatgaaacataataatggaaggaaatgaagtgatccgcacatgaaaaaagctgacggagaaccgccggctttaaatttgaaacatccatgctacgacggggccgaagaccgaccctaacacggcgcagagcgtcatggaaacagaactcatggagaccgttaattcaccgtactccattgcttttgaggtgccgagcgcatgggaggcgctcccgaatgcaattcctttcccgagtgagctgcggatgcggatccacttgagaagcagcggtcctaagataacgccggaaaaccctgcgatcatgacgaacacgactgtcatggaagggacaccgccgataccggacgcaatctgtatggcgacaggcgtggtaattgattttgggataattgacaaaatcaaactccggctgatgccgaacagctctgcaaatagcaggccgctgaccattccggagaataaaccggccaacacgccgccgatgatcggaaacatatacttgattaacacccggcgctgcttataaagcgggtatgccaaagccaccacggcggggccgagcagtgaattgatccattgtccgccgatcatatagtctttatacggaatatgaaaaacaagcagcacggcgataatgaaaatcgtagtcgtcaaaaccggtatgagaaaggggtatggaaagcgcacatataatttcaccatagccagataggcggcggccgtgaacaaaattataaggattgcgatacatgcttgctgcacttctttttctcctttctctgattggctttatgctctaacagctggctggcgtaccctgcggcgatcattgtgacgatggtgctcagcacgatgatcagaaacagagcagccccgctggcggaaaacagtgacgggtaattgatgacgcccgtcatggccggaatgaataacagcggaagaaaagacagcaaaaatccggctccgtcttcaatcattttgacgggaatgatcttaaccgataaacatatgatcagcaggatcaaaccgatgatgcttccgggaatgggcaggtgaaagaactgctgaacggctcccccgataaaggaaaatgcgaataaaataatgatttgcaagatgatgcgtatgactttcacaacgatgctgttctttggagaagagcagcttccccctttcttaatgtttctataagtttctttacttttggcacatatatttgtactatacaaatatatgtatgcaaaatatttctatatgttttctgagtaaatgtgcatatgtttgtattatacaactaatgttgctgttgtcaatgtaaggagtgaggcgtttgtcaaaacaagatccgattgaattaattgaatatgaactcaccactttcatcaggagagctgtttatcttgataactccgaccgtaaaatcggacatctggaaagggctgcgtatttgttattacggcagctggatgaattcgggccggcgcgtgtgaaggaattggccgaatcatttaagctggatatttccacattatcacgccaggcagcggccttggagtcgaaagagctgatccagcgtttttccgatccttctgacgggcgggtcagtctgtttgcgattacgaagcttggcaaacagaggttaaaagctgataaaaagatgcgtcttgagcggtatcatcgtatgcttgacgattggtccggcgatgaaaaagaaatgttcggccggcttttgctgcggctgaatgaggcatttatcgattaatgcatgatttttgccgggttaagcaggattatggcgtatacaagggagaatggaagagagtaaggctttacgccattctgcttagcaaaaataatattggatagggggcggaaaacgtttctcctgggaaataatgtttctcggaggctgcggcatttattatctcaatattcacaattcaataaaaatgaaagcgctttatttttagtccgttggttcagagtgcaaggtgtttgcctgaaaaaaacaattgtattttccacgaaaatttattatgatggaataaggaaattggagattatataacgataggaagatagaatatttccaatattgcgggaaatgaagattgagttaggttcaacaggtgcaccttctgcttcattatttcacatatatcagagctgttaagaggaggaagcgaagtggcaaacaaagaattaaagagaggcttaggcgctcgtcatatacagatgattgcgctgggcggcacgatcggtgtcggtttattcatggggtcatccagcacgatcggatggaccgggccgtctgtcctgctggcttatgcgatctcgggtatctttatcttttttatcatgcgtgcgatgggcgaaatgctctatgtagagccgagtacagggtcgtttgcgacattcggccataagtatatacatccgttagccggctatatgacggcgtggagcaactggtttcaatgggtgatcgtcgggatgtctgaaattatcgccgtcggttcgtatatgaaatattggtttcctgatctgccggcatggattcccggcattatcgccatggccattctcggtgcggcgaatttaatttcagtaaaatctttcggtgagtttgaattttggtttgccatgatcaaaatcgtcaccattattctgatgattgtggccggaatcggaattattttcttcggtttcggtaacggagggcatgcgatcggattatctaatttatggtcgcacggcggtttctttacaaatggtttttcaggatttttctttgctttgtctttggttgttgcggcctatcaaggggtcgagctgatcggaattacggcaggggaagcgaaggacccgcaaaaaacgctgcgaagcgcgattcagagtattatctggcggattttgattttttacatcggtgcgattttcgtaatcgttaccgtatatccgtggaatgagcttcactcactcggcagtccgtttgtttcgacatttgcgaaagtcgggattacggcggcggccggtttgattaactttgtggtgattaccgctgcgatgtccggatgcaacagcgggatattcagtgcgggacgtatgctttatacgttaggcgtgaacggacaggcaccgaaattctttaagaaagtttcttcgagcggtgtgccgatattcggtacgcttgcggtattaatcggacttgtgatcggtgtcgtgctgaactacatcgcgcctccgaaaatctttgtttatgtgtacagcgcgagtgtgctgccgggaatgattccgtggttcgtcattttgatcagccatctcggtttcagaagagcgaaaggcgctgggcttgataagcatccgtttaaaatgccttttgcgccgtttacaaactatttgacgatcgctttcttactcatggtattgatcggcatgtggtttaacaaagatacgcggatttctttggttgtcggggtgattttcctggcgattgtgacggtcagctattatgcgttcggtatcggcaagcgcatgcctggtgaaaaatcgaaaatagaagacgctgtataattcaaaaagacacctctcttacaggggtgtctttttcggcttgtccgcgagtggtatactggttaaaaaaagcagaaccgggggaaacatcgatgagtcattaccgtacgttattatttgatatagacaatacgctgctggattttaccgcttcagaaaccgatgctcttcaaaaattgttccaaggttcaaagctggagctgacggcagaggtggaagcccgttataaagcgttaaatcaagggctgtggaaggcgtttgaagagggggaaatgacccgcgatgaagtggtgaatacacggtttgcccttttgtttaaagaatacggccttgaagccgacggcgtgctgatgaatcaggcgtaccgccaatacttagaagaagggcaccagatgatagacggagcttatgagctgattgaacggctgagtcctttatttgatttatacatcgtgacgaacggcgtctcaacatcacaatataagcggctgggcgactccggtctgtatccgttttttaaagatgtgtttgtatctgaggacacgggttttcaaaagccgatgaaggaatactttgattatgtatttgcgagaattcccggtttttctgccgggcacgggcttattatcggcgattcattgagcgcggacataaaaggcggtcagatggcgggaatggatacgtgctggtttaatcccggaaagaaagcaaatgagtccgggatcatcccgacgtatgaaattcattcgcttgatgagctgtatgatgtgctgaacgtggaggttgtcgctttatgatttctcaatatatatataatataatttatatcaagttgtctcgggaaggattattatgaaaaatctttcttcaattagtacaagagtgctcatagagaaaaccattatttgtttttccttatattctattatcagttctatttttaaaacgccaacttttacggcttcggaatccgcttacctgctgattatcaccatttttttagtcgtcaacgatcatatcagattaaaatacctaagcggtcagtattcttttagatattatgcatcttttttagtaagtaaccttttatcaggcattttattgtttaaaattaactgtctcggttctcaaatatataatattttcttactgatcgagattattgtaacaactcgtaaactgccctggactgtagtaagtctgcattttattattttttttacagctcttaaagcagcagggaccagcgggaaagatatattgatgtcctatttagtgatcatggctattatttatctgtttagaaacgtactgctcgaaaaagcaaaaatacaaacattaaataaagaattacaaagtgtaaacactaaacttaagaattattctcaaaaaattcaagagttaactatttctaaagagcggacaagaattgcacaagagcttcatgattccctggggcattatttgatcgcattaacaatgaatcttgaattcgccgataaaatagtaagtaaaaatcccggcgaggctaaacaagtcatcaataagtcacatgatttatcgaaggagtgtattattaacctgagagaagctgtcgctttgctcaatgaccctgctcctcaaaaagggcttctgaaatcgatcaatgagatttttgacaattttcagcaaacaaatgaaataaaattcgagcttgatatggataataaagtagagtcagctgatccagatatcaagaattgtctctataaaacagtacaagagtctataaccaacgggataaaacatggaaatgctacgtttttttcaataaaaatacgtaagtcttttgaaaaaatctctatatcgataactgataacggaacaggatgttctgaaattaataagtcaaatggaataaacggaatagaaaaaagatttgccgcacttggaggagaggttgatttttattcagggctagattcaggatttactgtggaagccgtaatccccgagatagcagatctttaatcggaatgtgaggaggtattgatatggatattatcattgtggatgatcagcaaattgtcagggaagggcttaaaatgattctgagtctgcacgaggaaattaatattgtaggcgaagcttctaatggtgaacatttattagatttgctaaaacagataaggcctgaaatcattttaatggatataagaatgcccgtaatggacggcattgaagcaacaaagctagttaaagagagatatccggatattaaagtgattatcctgacaacctttaacgatagtgaatacatttttactggactgaaaagcggtgctgatggttacatactgaaagattctgattcacaagaaattattgattccatcaaaacagcatgtgaaggcaatattctgttaaatcctaaggtaacgctaaaagttgtaaaggctctaaattcggtagaacataataaagagcttgttcaagaaaataatgaaaaggaacagctggtgcaattgcttactcccagagaaaaagaagtcgctaaacagattatggaagggaaaagcaacaaagctataagcgaagcactgtttattactgaaggcacagtcaaaaattatgtatcaagaatactggaaaaacttcaaatgaacaaccgaacggagcttagcttatatttacaaaagcatatgtgattcaacttttttccttcaatcagaaaggaatttcatcaaattcctttcctccattttcttctgaatatatccggacttacaccttccgtatatgactaaagtaacgatgcgattcgtaactaaagtaataaggtaaatgagtactatagtaaattctaaaaatattccattcaggttaaaataaaagaaccgaaataccacgaggggtgttttaattatgcttgaattaaaaaaacttaccaaaaaatatgatgactttacggcagttaataatatttcgctgactgtagaagatggagaagtattcggactattgggtcctaacggtgccggcaaatcaacaatggtttctatgattagcactgttcttgcacctaccagcgggacaattaaagtagataataaatcacttaaggaaaaacctattgagataaaaaaaataatgggggttgttccacaggatttagctttatatgaaacgttaagcgctaaagataacttgaacttcttcggaagcctttacgggctgaaagggaaaaagctaaaagaaagaactgatgaggttctggagattattgaactgacagataaaaaaaatcaaaatgtatcagagttttccgggggaatgaaacgccgggtcaacataggcgtggcgttaatgaataatcctaaattattaattcttgatgagcctactgtaggaattgatccgcaatcaagaaatcatattcttgaaacagtaaaaaggctgaataaagaaaaaggaatgactgttatttataccagccactacatggaagaagtagagtatctttgcgagaaggtggcaattgttgatcatggatctcttattgctttaggaacgaaagaagaactcaaggaaaacttaaatgcttgtgacactttaactgttacttttaagggtgctgatgaagaggcactcagccggataaacagcattacaggaattgataaagtgacggtagatcataaacaaatttcaatgcttgtatcgacgaaggaaagaaacatcattgaaattgtagatgatatcaaaaatctggggatcgacctcactagctttaagtacgaggaagtaaatttggaaagcattttccttcaaattacagggaaaaacctaagagattagtaggaggaggctatcttgagaaaattattcaacttattttttcttgattttaagctgttaacaaaaaataagtcattttatttaaagctgatgctgtttccatcactgctaatactcatattgggcagtgtgttcagtaattcagattcaaaaatcgaagcatttgatgtagctttttactcagcagattcaggagagagtgtttctttaggtgatgtcttaaaggataaagtttttaagaaaggagatctcaaagatatcattcatttaaaagaagctgagagctacaatgacggtgaaaaattagttaaagaaggaaaggctgcagcttttatctatgtaccggaacactttacgaaagccgttatgaacaacgggaaaacaaatatcgatttaattggagataataataagaccatagataaaaatattgttcaggctgttttggagggctttacgaaaagcgtgaaaacaatgagtgctgagcaacaagaagtaataaaacatatcagccccggcggcagcgtaccaaaagaaaaaatagaaaaaatgatgaacgatttggccgataatgacgggatctccgctgatatcccaaaagcagcgacaaataaaaatgcggttcctgtcgattccatgcagtattattcaattgcaatggttgttatgttttccattatgacggcttttgtgcttgttcatagcattgttgatgagcggcagaataatacgctgttcagaattaaatctacaccgactttaaatattcagtatgtgcttggaaagttgacaggtattatttttgcgatcttaatgcagatgactgctgttattctgataagctgggtcgtattccgaatgaactggggcaacttgtttgatatttttgttattacggtagtatacgcatttgctataggcagcattgtattgttttggggttttaccgctaaggaccacgtggcggtgtccagtatggcttctccggttctttatatttttagttttttgggaggcagttttattcctaagaacggactgcctgatagcttgagggttgtccaagagatcataccgaacggtaaggcaataaactcttatttaaaagtcaaacagaatattggccttagcggcatgtatattgatttgcttgagctaattggtattggtctcatctttgtctttattaatattatggtattcaacaggaagaaggtggcgtagtagtgcaattgattgccatgattaaacatcagctgaagctgatgctccgaaatagattagcaatttttgcaactatttcagtgccgttaatccttacatttttgttctctttttcccaagatacggatagcaaagagaacttgtatatagccaatgctgataaaagcaactatgctgcaaagctcattgaaatgataaaagagcataaaaatattaaagttataaagctaacggaaaatgaaataaagaaaaaagtcgatgatcaggatattccttttggggtcgttattgaaaaaggttttggaaaggaattggcggacaatcacaagataaaaatgaaaatcatccaaaactatgagaacggcagcggaacattgttagagcagctggtcacaaatgaggcgggaactcttaaaaaggtagttaaagattcgcaatatatgtctgcacagttgcatacggactcaaaagatatagaaaagaacattttcaagaaattgaaaaacaattcaggaatagaagtgaatgacaaaacattaagccagggtaaacatactcaggataatgcgaccgtgagattaattggttttcttgtaatgtttatttggtttgttgttattcaagggttaagaacacttattgatgaaaaagagaataatactttcagcagattactaagtacgcctataaactatacaaaatatgttttatccaaaatggctgctacttatatttccggaatcattcatataatcgttataatacttgcgggaaaatacttactcaagatcagcataggtcataacatctttgccatcgctgttatgctcgctgtttatttatttgcattgacctgcattacgatgattatggttccatttatgagaagccaaaagcagtttacttctgccgcatcgatcataattgcagtaagcggaatgataggcggttcctttttctcattggaaattgctccaaaatatatgcaggttatttctaaatttacacccgaagcatgggcaatacagtctttaaacaacattatctttagtaagagtaccttaggaactgaatggcttccgatcgtaatttttgcaagtgtcggcttattaagtattattgtatctttcatcttgataagcagggagattaaaaaagaaaattaaatcaacaataatcggataaaattaacagatcaaaaaggacgtgaggaaattgggtatggaagaactatttggaatggctgaattaattataggtgtactcatgaatgtatttatcggtaaaatcgggcaagttgcttttggaaaagataacagaacaacaaggatcattttaagagtaataggaatcttcctcatcatcaacggagtttcaagagcatttcatatataaaatgagatagtaaaaacatccttttcagggtgtttttttatcgggttattacaaaatttctgaggtgaattatgaaaaaaatattttgtcttccgtatgcagggggatcaagtgcaatatactataaatggagaaggttaatgagtgactctttaacaatacatcctattgagttaaaaggaagaggtacaagaattaacgaagatttttatgaacatttagatgaggctgttaatgatatatatgatctgataaaggatcaaatcagggagtgtgattatgctttattcggccacagtatgggaggccgattagtttataagttatattgtaaaattgctgaaatgcagcagaagaagcccaatcacatatttttttccggatgcggcattcctaaaacgaaaaaagcagaggggatgattcatgctttgccggataatttatttttgcaaagaatcatggatatgggcgggacttcggaagaactgttacataacaaggaattacaacaattatatcttcctattttaagaagtgatttcaaaatgttggaaaaggatgttatttctgaaaataagaatgttatggactgtgatataacagtgttgcatggtattaatgacaagacgataagctcagatttaatatgtaattggggacattatactttagggaaatgcaatttttatacgtttgaaggaaatcacttttttattcatcaattttcgaatgaaataactgacattataaataaaaccttgagataaattgttgattgaaaaatcgggagtgttactttgtcccggtttttttttatgttaatacgaaaaataaaaactgggttaatgtgcttaggtgtttttccccgctaattgacaactcttaaatatttgtataatatttcttaaagatggctagttcttcttcattatcctttttttaaaaaaagtgtttatacgggtctatatcattaaaaaatggtttttgctgccgataaataaactgtcagactacaacaacaattattggtgagcgttattgcctgtgatgcagtttaacataaaaatccaccgaaagcctctgctgttttaattcagtgaatgaattgaattttgatatcaagtgaaggagtttttgttatgacaaaaagtataaagggagataaaaacagtattggtgagttaaaaactgaagagcattttttagtgggaagtaaaccttctaaagaaaaaagaatgaaaaatcttacatataaattgtcacagcaattaagcgataagctgaatgtatgctgcaatggatcggatgaacgtctgcatgtcgtattaacagcggcactgactttgttaataaatcaatatacagaaagacaaaatattgtaatcaagactcctgttttcagaaagaacagaacgattgattctgagcaagaaattttgactcttaaaaatgctgttcatggtgaagacctattaaaagagatcatacataaagtcgaattcaccgtagaacaggcattggaaagcccccaaaataattctcgaacaagtgataaaatgactggccttccttttgatgtcatgatagtccttgaaaatattcaagaatacatacttaatcaagaaaatcccgctattcatatcctattttcgtttataaaccagaaacaatacatagagacagccatacactataacgaatgcctctattctcaaaatatgataaaagatttgtcactgcgatttcagatgatccttgaagctatgataactcctgaaaatatcagagtgaaagatatgagattcctgaaagaaaaaaataagcaaaagaaaatctttggctgggaagataattattcgaaaattggaacaatttcggaggtgtttgagcagcaggctgatgaatattcggataagactgctttggtactagaaaactcttcaatgtgttacgcagaacttaatcaccgtgcgaaccagctggcacggtatcttcaggagtgcggagtaaaacggggagaccttgtcggaattgctttagaacgctcttttgatttgtatattagtattctggcaatattaaagtcaggcggtgcttatgtgccgttagaccctcaatatccgaagcaaagactatcattcttaatcgaagattcaggtgtagagttgctgattacaaacgaaagcattcagtcacaactcccgcctcacggggacggcgtaatctgtttggatggtatgaaagaagaaattgaaaagatggatggatctaatattggcataaaaggttccttggatgacctggcttatgtcatgtatacgtcaggctcaacgggactgcctaaaggagtaagtattgttaaccgcggtgtgattcggctggtgaaggagactgattatgcggtatttgatgagaatcaaacgtttctgcaattagcttctgccgcttttgacgcttctaccttcgagatctggggctgtttattgaatgggggatgtctggctataatgcctccgggaataccgacggctgatgatattgcagaagctgtaaaaaaatataacattacgactctttggctgacggccggtttattttctctagtagttgatcagcagttagaatcattaaaagggcttcagcaattattggtaggcggagatgtggtttccgttccgcatgttcaaaaagtattagcacttggaaaggtacaagtaattaacggatatgggccgacagagggaacgacctttacctgttgtttcccggtccctcatgattggaaaggcagtacgcttcctatagggaggcctatttctggtacagaaatattcattttagattcgcaattaaaaccggtagcgcctggtattcctggtgagctgtttattggcggagatgggctggcgcgagagtattggcgacggcctgatttaacgaaggaacggtttatatcacaccctttcaataatgatccttcagcacgtctttataaaacaggagacttagtgcgttatttagaaaatggcgatgtggagtttatcggacggcgggacgagcaagtcaaaatccgcggttttagaatcgagcttggggagatagaagcccgattgatcaatcatacagaaattaaagaagcggcagtaacagtaaatcataatggtgatgatgatttatatatctgtgcttattacacttcaaatcataaaatcgcaaagattgaattgcagcactttctgagagactttcttccggaatatatggttccatcgtactttaaacaaatggataacatgcctttgacggtaaatgggaaaattgacagacgggcacttcctcgacctgatatatctcaaatgtccgaaacaaaatatgaagcgccgacaaatgaaacggagaaaaaactttcggagatttgggaagctgtacttggcagggaacgcgtcggtatagatgaaaatttctttgaaatcggcggtcattcattaaaggcttctatgttaatttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgatcgaactaaacggaaaattagatgtaaaaaaagccgaatcagttttacaagagattattggcagacacgaagccttacggacaagtttcgatgttgtaagcggcgatgtggttcagattattcacgatacatgggagctcgaatttaattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaagagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatgtcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctttttgatgtcatgtttacttttgagagtaaggattacggattcggaggaaatgaagagacagcagaatcaaatttactagtatctgaggtcaatatatcaagatttgatttaacgttaactgcaatggaaaccgatgaaggcgttaacttccaattggaatattgcaatcatttattcaggaaagacacagtcgaaagaatgggtgctcattatacccggcttttacaacaggttgtatcagaaccggacacggcaatctgcagactgaatatgataacggatgatgagaaacataaactgctttatgtattcaatgatacagcagccgacttcccgcataataagacaatccatcaattgtttgaagaacaagcggaaaagacaccggaaagaatagcggcagtgtatgaaaataataaagtaacttataaagaacttaacgaaagatcaaatagtctggcgagaatactaatgaaaatgggggtgaaaaaagagtcaatagtaggtattgttgctgacaaatcattagagatggtgttaggcatattgggtgtgctgaaggcgggaggcgcatttttgccaattgatccgggatatccttctgagagaatcaaatacatgattgaagacagcggttctgacattttattagtgcagaatagtcaggctgacaatattccgtttgacgggaaggttattgatttaacagatagttctctttacaccggagatcggcataacctgccaatgatgagttccgcagaacatcttgcttatgtcatttatacttctggaacgactggaaaaccaaagggtgtaacgatccggcatatcggaatcagtaatctcaaaagtgtctttgaacatgatatgaatatcaattaccgggataaaattattcaatttgcaagtttttcatttgatgcatcagtgtgggaaatcagtatggcactgttgaccggagcggaactacacatcctttcaagtcaagtcatcaataattatacattatttgaagagtatattaaccggcatgacattactgtagccactttgccgcctgtatacatcaaccatataaatataaacggattatcagctttaaggctcttaattactgctggttctcagatatctacaaaatccttgaaccggatcgtgaataaaatagactatattaatgcctacggtccaactgaaacgacaatctgctctacaatgtggagatactcagaagctgagagggcgatggcaaagaccattcctatcggtaagccgatcagaaatctgaaagccttcataattgatcacaacaacaatcttgtgcctattggtttagcgggagaattgtgtgtgtcgggtgacagcttagcaagaggatatctcaataaagagaaaatgacgcgtgagaagtttattgatcatccatttgagtccggaactaaaatgtaccgaacaggagacttggcaaggtggcttcctgacggaaacatagaatttttggggagaattgataatcaagtcaaaatcagaggcttccggattgaaactgatgaaatagaaagccagcttctgaaaataagcgggataaaagaagcagttgttatagataagtgcgaccttcacggtgacaaatacctttctgcatttgtaaccgcagaatataaaatatccggagcagctttgagggagcaattgggtgacattttgccgcaatatatgattcccggtgtcatcatccaggttgaacagctgcctctcacaccaaatgggaaaattgacaggaaagcacttgcagaaatagaagagcctaaacatataaaggagcaccttgaagcaccccgttccgaagtcgaacagattctggtaaatgtttggtcggaagttctgaaaattgatgatattggtattaatgataattactatgagctgggcggagactcaataaaatctatactgattgtatcaaagcttcaaaaatacagtctcagtctagaggtaaaagatcttttgcagtatccgcaaataaaaaacctcagtaaacacgtgaaattatataaagctcaaacagatcagagcccggttagcgggagaactgaactggcaccgatacaaaagtggtttatagagaatgactttgcggacattcaccactttaatcaggcattcatgtttcaagtgaaagaaaaaattaatgaacacgctctggcaaagacatttgaattattagtaaagcatcatgatgctttgaggttgatatatacagccgaaaatgacgaaataaaacaagaagtcagagatgtccaagccgcccgggatacttttactctggacatatatgatctgcttgctgatacggattacaaaaatacaatagaaaaacttgccgatcagttacaaagcggaatggatcttgaaaaaggacttttaatgaaacttggtttatttcgaacaatgaggggcgattatctacttattgctatacatcatatggtgattgacggagtctcttggagaattctgcttgaagatatggagcaggtctacaacaatctgcaaaaaggagagccggccgttcttccgccaaaaacggcatcctttcaagaatggacacgtaaattggcggaatatgcaaacggaagtgagataagaaaggaacttcggtattgggagaatatcgagaaaacgaagattaaagaaattccgagagatttcaataaaactgacagtgtatttaaggaaagccgcaccattactgtcagtcttacaaagcagttaactgataagctccagaggaatacaaatgcagcttataacacacagattaatgacatcttgctttgttcactgggaatggcagtaaaagaatgggcgggacttgacaaggttttaatcggtctggaaggccacggaagagagaacatattagaaaatatttcaatagaaagaaccatcggctggttcacctcactatttccgatcgtgctggatatggagcacagtgatgatctgccttattgcataaaaaatacgaaagagtatttaagaagaatacctcataaaggtattggttacggaattattaaatacttgacggcaccggcacataaaaaagacatcagttttacgataaagcccgagatcgggtttaactatctgggagaaatctctcaaaaaaagcgggctgtttttcagcatgcagatatatcatctggtacaagtgtttctttatctaataaaaaattgaatgccatcgaaatcaacagctttattatggacggtcaactgcagttggaatttaactatagtacgaaagagtttaaagaagaaacaattaaaacattaaccgaatcctatataaaccggttaatcgatattattcagcattgcggaatgaaaaaaattcctgaaaaaacaccctttgactatggagatctggatttatccatcggagatttggagcagattttatcaagcggaaaagagatagagaaaatccactccctgactcctatgcagagcgggatgctttatcatgcattgcttgatccgttttcacaagcctattttgagcagcttacattttctttatccggtcagcttgatattggcagattaaatacagcttttaatatgctgatcgagaagtatgaaattttaagaacatgcttttttcatgaaggactaagtaagtttaaacaggctgttctaagagagagaaaagttaaaattgaatttgaagatatcagcactttctcggaatatcaaaagaaagtccggcttaaaaatgtccagtttaaagacaggggaacgagattcgatttgacgaatgattgcttaataagagtaaccgtattaaaaactgatgagaaagaatataaactgctgttcagttttcaccatattattatggatggctggtgtatgagtttaataatgaatgatataaaaactatttatacgtcattaaaagaaggaagagagacagtgcttcagcataccgagccttacagcacctacttagaatggctggataatcaggacaaaagtgccgcattagaatattggggggattatctaaatgaatatgagcagcaagccggtattccaaagttctgctgatgagggcggtttcaataataggaagaaaacattcattattgatgaaacatgtacttcgatgttgaaagctgcagctgatcaatatcacattactttaagtgcattgattcagactgcatggggagttcttttgcagaagtataacaacgtggatgatgttgtttttggtgcggttatttccggaagacaatgcagagtgcaaggcatagaaaaaatggtggggttatttatcaatgcggttcctctgagagtaaaaggcgatggtgatacggtatttatagcattagcccaaaagctgaacagtgactttatcaaagcgaatacatcatacggttacagttctttagcggatatacaagctcttacaaagatgaaagagaaactgatcaaccatatgttggtttatgaaaattatcctgttgatgactatggcaaggcggtcgataatacaactgatgctttaaggattacagatatggaagtgtttgaacagacgaactatgactttgggctggttattattccaggcagccaaatcaaagcagagatgacgtataacaataatgtttatcgtgaagatatcattaatcgtataggtgttaatttctgtcatgtattaaagcaagtggcaactgatcctacgcgtgtcctgaaagacatcagcgctgtaaatgaagaagagcgcggaatgctccaggagtttaataagcagtcctctaattatacggtgaataaaacgatacaagacctttttgaagaacgagcggaaaagacacctgaccaaacagcggctgtctatgcaggaaagcatatcacttataaagagctaaacgaaaaggcaaatcaagttgcaacattattaatggaaaaaggggcaggaaaaaacagcattacggctatgatgatccgtccttcagaatattcaatgattgggatgctgggaattttaaaaaccggaagtgcgtttctgcctattgatgatgaatcaccggtcagtcggataaatcatattttaaaagatagcaaagctgatatcctcattacagatttgtgctttttagctgataaaaacattgcggcggaatgtttggatattacggataaatcgatttataccagccaaaatacatcaaaccctgatgttcagtatgatctcgaggacgaggtatatgttatatatacctcgggtacttcgggaaaaccgaagggggtgaaggtgaaaaataaatcattagttaattattcattatgggtatgtgatcaaataaacataaattctgacagcaggtcgttagtgacgtcaaaatatagttttgacttatgctacaccagtatatttccagttttatccggtggcggacaagtccactttgttgataaagaagtgtatcttcactctctatcattaatagaatatattcataaaaatagtattacatatcttaaaatgacacccactttattttcaacattgatggaggatgttgacatgctggcgtcttgtcctgatttaaaagttattatactgggcggcgaaagcataaacatcggcaacgtcaaaaagctcgctgaaaaatgcagatggatgaagtttattaaccattacgggccgaccgaaagcactgttggctgtattgcacatagcattgatctagatcatattcaaaactgtgaaatatacaatagaataggaagaccaattcacggtattaatatctatattgtggatcgttcagatcaactggtccctgtgggagcacctggtgagatttgtatcagcggggtaggtttagcatcgggatatgtcaataatgaagaattaacgaatgaaaaatttattgataatccttttcatcgtggagcaaaaatgtacaaaacaggagaccttggcagatggatgccggatggaaatatagaatttttaggccggattgacaaccagatcaaaattaggggttttagagttgaaatcggagagatcgaaaaccaactattacagctggaaggtataaaagaagcggcggttgtttatatagaggagaaatatctttctgcatatattactggggacattgagatggaaggctcgttcgtacaggagaaattggcacaggttcttccgaagtatatgattccgagtttcataatacaactgaaagagttgcctcttacagctaacggaaaaatcaatcgaaaagagctgcctcttcctgacttgcaacggttgtcagtacctcaatacgaagctccggcaaatgaaacggaagaaaaactagctgaaatttggaaagaaatgcttgggcataaacggatcagtataaatgaagatttcttcgaactgggcggacattctttaacagctgcgttcactatttcccgcatcaggaaaacattcggtacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgattgaactaaacggaaaattagatgtaaaaaaagccgaatcagttctacaagagattattggcagacacgaagctttacggacaagtttcgatgttgtaaacggcgatgtggttcagattattcacgatacatgggagctcgaatttgattatcagaagctgccgtctgatgggatacgaccatatgtgaagcagtttatcagaccctttcatttggacaaagcaccgttaatcagagccggattcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatgtcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttgtacttgaaaatgcagattacggtattgaaaatcacttggatccaaatccggaagagcatattcaaaccgagatcaatatttcaaaattcgatttaacgttaaccgcgacggaaattgataaaggaatcaagttccacttggaatactccagtcaattatttgaaaaagaaacagccgagagaatgggtgcccattttacgaagcttttacaaagtgcagctgccggcctagatcaacctttaatgaaactggatttgattcctgaacaggagaagcacacattgctccatatattcaatgacacggcagctgaatttcctcggaataaaacgattcatcaattatttgaagagcaggcagaaaaaacacctgaacgtattgcggctgtccaagaagatacgctattaacctataaagaactaaacgagaaatcaaacagcctggctaatcttttgagacaaaaaggaattagagaaaacagcattgtcggaatcatgacagagagatctcttgagatgatcatcggaattatcggggtgctgaaagcagggggagcgtatttgccgatagatcctgaatatcctgatgaaagagtaaattacatgctgaaagacagtgatgcaaacattctcctaattcaaaacggattgtcaggtggtattacattcaataaagaaattttatcattaagtgatcctgctctatatatgcataacagaagtaatctgccgaatgtcagttgcccggaagaccttgcctacatgatttatacttcagggactacagggctgccgaagggcgtcatggtaaaacataaaggcgtggtaaattatattcattgggcaaataagatatatgtaaatgatgaagatattgattttcctctgtattcttctatttcttttgacttaacggttacttcaatttatacaccgcttatttcaggaaataaaattattatttatgagggaccggacaaggctcttctgatcagaagaattatagaagaaaataaagcggatattattaagctaacgccgacgcatttgagattgctggagaatgtagatttaagtacgtcaaagataaaaaaaataatcgtcggcggggaagagctgaaaaccgggcttgcaaaaaaaatacacggtgcatttaacggtcatgtcaaaatctacaatgaatacggcccgacagaggctacagtcgggtgtatgattcatcaatatcatattgaaagagacaatggcaatgcagtatcaataggcaaacctgcggataatactaagctttatatattaggaaaacaattggaattacttcctttaggggcagccggggaactttgtgtcagcggagaaggacttgcagacggatataaaaataaagcgggcttaacgtcagaaaaatttgtagataacccctttgaacccggggctaagttatacagaacaggggatatggcaaaatggatgccggacgggacaattgattatttaggaagaattgatgatcaagtcaaaatcagaggatatcgtattgaaacgggagaaatagaaaaccggcttctgaaaatgagtcacataagagaggctgttgttgtagcgagagatgaccaacatggggataaatatctctgcggttatgttacttccgacaaaaaaatagatgtttatgctttaaaagaaaatctgtctaaagaattaccgttatatatggtgccaagttatatcttccagattgaaaaaatgccgttaagttcaaacggaaaaatagatgcgaaatcattgccgattatagatattgcggatgtattggagtctgcatatgaagcaccgcgaaataaaaaggaacaaattctcgcatgcgtatgggagaaagttctggggatgaaatcaatcgggattaactataactattacgagatcggcggagactcaattaaatccattttagtagtttccgaactccaaaaatacggcttaaaacttgaagtcagagatttaatgaaatatccgcacataaaagacttgagtgctcacgtaaaatcagctgatatacaagcagatcagtcgattgtagaaggagacgttgatctgacaccgattcaaaaatggtttatagaacagagatttgaacaagaaaaccactataaccaagcctttatgctttacaaaaagtccggcatagaagaaaaagcaatcgaaacggcctttttggaactggtgaggcatcatgatgccctcaggatgcagtttaaaaaggaaaacggtgaaattaagcaatggaataggggcattaaacaggcaaaagaaacatttactttagaagtatttgatatgacacaaacagaagatccagccatggcaattgaatcactggctgaccgtatgcagaacgaattgagcttggaaaaggggattttaataaaactggcggtatttaaaaccaaaaacggagatcatcttctattaaccattcatcatatgatcattgacggagtatcttggagaatcctattggaagattttgaaacagcttatcttcaaacagttaatgggaacaaggtggagctggaaactaaaacagcatcgttcaaagaatgggcgcgtcaattgaaagaatatgcaaacagcaaggctcttcaaaaggaagctgggtactgggagaccatagaaacggctattattgaacctcttccaaaggatttcattgccgaaagctgctcttatgaagatagtaaagaaattaaaattgaattaacagaggatcaaacaaaaacacttttaagaaatacaaatgcagcatatcatacacaaattaatgatatattgctttgctcactgggacttgcagccaaagaatggaccggcaacgagaagatccttgtgaatcttgaagggcacggccgtgaaagtgttataaaaaccccggtccatcgcacaataggttggtttacgacaatatacccaattgttctcgatatgacggaaagtaatagtttatcaagctccattaagtatacaaaggaaatgcttagacatatcccccataacgggattggttacggaatactcagatatttgtcggactcggttcatcttcaattaaaacctgatatcagttttaactacttgggtgaatttggccaagaagatcgcagcaacctatttcaaatatcacctttgtccgccggaacgagcatatctggaagaaataaaaagacacatagtatagaaataaatggatatatcatggatggcaggctgatgtttacgttcaattacagtgcaaaccaatataaacgagagacgattgagcaatttacgaaagcctatcaattgaaaataaatcagatcatagaacattgtgtgaataagaaaatatctgagaaaactccatgggattatggggatcccgatcttcaaatagaggagttaaatcaaattcttgcaagcggtgctgaagtagaaaaaattcattctctttcaccgatgcaggaaggcatgctgtataacgctgtgattgaccatcaatctagcgcttatttcgaacaaagtgaaataacagttgaaggaaatctgaatacagaagttctcagtgacgcattaaacaggctgattgctaaatatgaaatattaagaacgtcatttttctataacggtttccgtgtatttaaacaagccattttaaaagaaagaaaactaaacattcaatatcatgatatcagccaatgggaggagcagaagaaggatgcctttgtagggcaattcaaggtgagagacaggaatactccgtttgatctgaacaaagattgtctgatcagagtatcggtgatcaagctgggaagaaataaatttaaagtcatatacagtttccaccacattattttggatggctggagtgtcggtatcctgttaaaagagcttatggatctatatggagacgtggctgaagggaaaaaactccttcaagaatcacctgtaccgtacagtcgttatcttgaatggcttgatcagcaggacaaggaccgtgcatttgaatattggaaggaatatctttctgcatatgaacaagagatctcatttccggaactggaattgaaatctgacgagtatcagcatgatcaaaaactgggagcgcttaacggtgaaaccgccgctaagctgaaaaaaatcgctgagtcaaacagcattacattaaattctatcgttcaaacagcatgggggatattgcttcagaaatataacaatacaaatgatgtggtatttggttccattgtttcaggcagaccgagtgagataaacggaattgaaaatatggtcggcttatttataaatgcagtgccaatcagagtgaaaagagaatgtgatacatcatttatttcattggctaaacaaataaataaagactttattgaagcgaacgaatacagttattgttctctggcagacatacagtctttgacaagtatgaagaataaattaatcaatcacgtagtcgtgtatgaaaattacccgttgagtgaggatcttttccaagattcagcccgttcgagtgtaaaaataactgctgaacatgggtttgaacaaaccaactatgatttagagcttttaattgctcccggtgacgacttgcatatgaaaatcacatataacgccagtgtttacagtaaagaaacggtaagttcaatcttagataacctggttagcatcttacagcaggcagcggctgatcatgaagtaatagtttctcagatcgatatggtaaatgagacagagaaacaaaagctggtgaaagaattcaactgcacggaattatcatataagaaagaaaagacgttacaagagctcttcgaagagcaagctttaaggacacctgatgcaatcgctctggaatggaacggagacttcttgacctataaggagctgaataataaggcaaatcaattggcaagagccctcagggaaaacggcatcaaagagaatgttgtggttcctattttggtaagaaggtctttccgattgattataggaatattaggaatactaaaggcagggggatgctacttaccgcttgatcctgattatccggcagacaggatcaattatatgctgaaagacagtaaaagcggcctgctgttaactgaagaaggacttccaaatgaattaacgtacagcggaaccatatttaacatagattcagaggatttattacatcagttggagacgaacattgatgttattaacagggccgaagatttagcatatgtcatttatacgtcgggatcaaccggaaaaccgaaaggggtcgccgtagagcaccgtgccgttcataactttattaagggaataacagacaggatcagcttttcacaagacaatgtccttctttcggtcaccacgtgctcatttgacatattcggattagagtcgctgctgcctttaactcaagggctgaaagttgtcatagccggtgaagcggaacaaagagatccgtacttgttaaacaagatcgttgttgagactgatgtcaatactattcagcttacgccatccagattaaagctgatgctaagtgcagaaaacagcacggagagtcttcagaaattgaagaccatcatggttgggggcgaggtatttcaacgggaattgttatttgagctaaaaaaatataaaaatctgaagatctataatatgtacggtccgactgagacgacgatttggtcttctgtgaaagacttaaccaatgaaaatagtgtaaatataggcaagccgattgcgaatacacagatatatatagtagatcatgatggaaacactgtaccgctcggcagtactggcgaattatgcattgctggagccggaatggccagaggatatttaggaaaagaagatttgactgcgcaaaagtttgtagacaatccgtttgttaaaggaaccaagatgtataagacaggagatttagcaaggtggctgccaaatggtgaactggacgttatcggaagaatggacaatcaggtaaagatcagagggtatcggatagaattgggagagattgaaagcatagtaaaccaacatgaaaaagttaaggaatgtgtagctgccggaaaaacaaattccgcaggagtccaagatttagttctgtattatgtggcagaaagcactgtatatccttcagaatttattaagttattatcacctgtgcttcctgagtatatgattccgcagatctttatgaaaattgaccaaattccgctgacagcaaacggaaaaataaatgtcctggcactgcctgaacctgttatagatagaacaggttttgaccggccttttgaggaagcggtaacggatgtacaaaaaagtatcagccgtgtttggaccgatgttttaaaaatagaagagcctggaatacatgataacttctttgaagcaggcggtaattcaatcaaaatcgttgcagtttataatgagcttcagaagctgtatccaaaacaaattcaaattgctgacttgtttgcatatccgactatttacagattgtccgaatatatagaatcagctatagcctttgcggagatagcagtgtccttggaaaaagaaatcattcctattactttaccgcttgaatacatctcggaatcaactggacaaagtcatacagccatgcacgaatatgcggtaaatgcgaattattatgatggtttaaaaacaatatgcaatacctacaaatatgatatttctcatgttttattagcgggttatgtatttttattagctgatgtcagccagcaaaacttggttcatatccaattttcgggtcatggagatgatcggatgagtcagctgtcttttgatctgtctgatatcgagaattttcacgatattattcgtatggcgaaggagcagattgagaatcaagaggattcacaatacgatttgaatactcactataagaaatcaagttcggcccaagatgtttttcctcttttttatattagtaatgaatcaaaaaaagagtactcagaattatatgatctggtttttgcagttcatgaaaagccatccgaagcagaaatcgtttttatatataaccatcagaaactaaatgagcacaaaatgaaagatttattttataactacatgaatttgattcaagtgattacagcagacaaagcagacaattcaatataaagcggccggttctgccttacattttgctgatcggcagaatgtaaggcaaatcaggcattatagggactttggaggtatttaaatgtcgaaaataggttttttattttcaggacaaggatctcaatatgcaggaatgggcaaacgtttatgtgacaattttattatcgctaaaaaaacgtatgacgaagccagtgatgcattgggatttgacctgaagaaattatgtatagatggaagtgccgctgagctatctcaaacagaaaatactcagccggccatcctggcaacaagtattgcacaattcagaatctacatggaagaggtcggaaaagaacctgaatatatcgccggccatagtttaggagaatattctgccttggtttgcagtgacgttttggatttccaggacgctgtaaagctggtgagagccagaggattattaatgaaagaagctgccgaacaagggaccggagcaatggctgttatcaggaacctggatgaaagaatagcagaagaagagtgcgaatctctctcttcaagaggaaaaacgattgctgtttctaactacaatggatataaagatgttgtggtatccggagaagcggcagcagttgaagagcttagtgaaactcttaaagccagaggagcagacatttttaaattaaatgtaagtgctgcttttcattctccgatcatgggttttgctgcggaaaaattcagccatgagttaaaaaagtatgatctcagaactccaaaatacaaagttttatctaatgtgacggctcttccatattcagataaacagcaaatggctgacatactgggaactcaaatcgtaaaaccggtaaattggatgggaatcatgaagtatttagaagcaaatcatactgatactgtgattgaatttgggccgaaatctgtattaaggaatcttgtaagaaacaatatcgctgacatcaaatcgtacagctacgacaaagaagaggacgtgaagattataaaagagactcttttgaacgaatctgtttcactgcaagccggtttttctattatctcgagaagtttagggatcgcggttgctactaaaaattacaactggaacaatgaggaatacgccaaaggtgtaatcgaaccatatgaaaaagtagctgccatacaggctgaacttgaaacatcaggtcgtcagccgtcaagagaacaaatgcatatggcagtagaaatgctgaagtcagtgtttcgaacaaaaaaaacccctataaatgaacagaaaaaaagatttaatcaattattttctgaaacaaacacaaaaaaacactttgaagactttgaagtttgacaggtatgatcacctatctagtgattctcagcgaggtaaaaaaatgaaaacagactttataagtttaagtaacttaaaagcggccgcttttacaaatcaaactcctaatgtaaagaaacaaaaaaacgaggaagggaccaaagacatttccggagatgacattgccattgtcggtttatcatgcagaatcggcgaagccaatcacgtaaatgaatattgggatttacttttacaaggaaaagagttcatcagagacattcctctgaacagaaaaaaagatgctgaccagtcattaaaaaacagcggaaccaagtacagtaaagatgcagcctatacaaaaatagcctatatggatgagattgataaatttgattgtgactttttcagtatccttccaaatgaagcaaagttgattgatcccagacaaagattatttattgaaacggcctggaacgcattggaagacgggggttacggcggcggaaaattatgtgggacaaatacgggagtatacattggactcagcagtgacggctcaaatgaatacttcagattgcttgaaaaaggagatcaatcattactcggactggctaccgcgggtaacattaaatcagttatcgcaagcagactgtcatatatcttggattttaaagggccagcaatggtaatcgatactgcatgctcttcatcgcttgtcgccctccatacggcttgtcaggcaataagaaataaggattgcgatatggcattagccggcggagtgaatataaaagtattcccaaagacaatagaggagagcaggttaaatatcgggaattcttcatctgattttgctgtaaggactttcgatgattctgctgacggcacgaatagcggcgaaggagtcgctgccgtattgctgaagccgctggcccaagcgattcgtgatcatgaccagatctatgcagtcattaaggggagcgctgttaatcaggacggcagctcagtaggaattaccgctcctaacgcagcagctcaagaacaagtaatagtagatgcgtggaaaaatgcaaaaatagatcctaaaacaattacatatattgaagctcatgggacagggaccaaattaggggatccgattgaaataaatgcgttgcaacgggctttcagaaaatatacagaccgaaaacagttctgtgccgtatcttcagtcaaaacaaacatcgggcatcttgatagtttggcgggaatagcgggtttaattaaagcggtaatggcattaaagcataaaaaaattccgccaagtttacattttaaagtgccgaaccgaaatatcaattttcatgaatcgcctgtttacgtcaatgactccgtttcagcatgggagagcagcggagtatacaggtgcggcatcagcagttttgggctgagcggtacaaactgtcatgtcattttagaagaggcacccgcagttgaaaaagtcgatcaatccgttttatctgaacatatttttactgtatcagctaggactaaaacatctctcgcgcacttgcttacagatcatattgattatttaaagagagaaacagatgtgaatctgggagatatatgttatacagcaaacactgggagattgccaaacaaatacagactcgctatggtaataagctctgtcgcggaactgctggaaaagctggagtttttatcatgctctgaatggaaaacgtatcgggagaaaaatatatactttcaatcgataacaaatcaaacaaagtttataggaaaaacgcatacagacagtgtgcagaatactcaaacaataaaaaatgtgattcaaagagtcagacaagacgtctctaatattccaatctctgacttacatattttatgtgaaatgtattgtgatggggcgaatattaactttgaagatctttatagcgagatgaattttcaaaaggtcagcttgccgacatacaaattcagcggaaaaagattatgggctgagctggctgcagacggcccttcagccgatgagaaaaaacaatctttattgagcaatcttgcagtgcagtcactgaatctggaagtgtatatatcccatttgaatgtcactgattattggtttttaaatgaacataaagtgaatgattcttacgttatccctggaacggtttatatagaaacagctagagaagcgggaagaaaatacttcggcgaacctgtcggcattctgttaaaagacgttacgttttcaaatcagttaaaggtaaaagcaaatgaagttaaagaagttcatacgatcataaagaaaaaggacagcgttttagagtttagtgtgataagtaagaccggcgataaatggataaaacacgcggaagcggtcattgcgaaagaagaaccggtacgggaaacatatgacattgaggatttaaagaaaagctttaattctgtttatgtcattcaacgtaataatcatccattgacggaaataaacaccgatgaatacaagtcggtttatcatatagaagataccaatagaccggaaagcatcgttcaagtcggaggcagatggaaatgcaccaacgcaatctacagagacgacgacaggcttctatgtgaattggaattgccgaaagaatatgagagtgatttcgttcagttttcgcttcatcctgcgatgatggattgtgccgttaatgccgggacattcacaatagataacgaaacctatctcccttatttttataaagaatttaagatttatggctctgcttctaaaaagttttacagttatatcaagaaaaagagccgaagcaacggggaaacaggaacgtttcgcatcgtcctgctgaatgacactggagaagttttcggtgaaatcaacaattacatcgtaaaaagggtgcataaagcagctgaaaagactaaaagaaacaatatatatcataagctatcttggataagagaaaacgatcaatcacacgagatgcgagaaattcatcatcctattttattatttaagaataatggctgcagtttatccgaggaaatcattcgaaggttagaactggaagggaaaactgtgattgtcgcggaacagggtgactatttctctaaaatcggaagccatcattatactgtcagtgattctcaagaagattatgactgtcttgtaaaagctcttcaaagtgaaaaggtttctcagattgtccatttgatgtctatcagcaatgagaaagacaaaaacatatatcagcttcagaaaaaaatatcctcaggggtagacagtttattttatttaacaaaatcacttgtagaaaatacaaaaaataacatagaactgatgctgtttgcagaccttgcacatcaagtaagcggtgaagaaccagacattaacccgcataacgcggcatttttcggttttggaaaagtaattgaaaaggaatattcgcgtgtaagtgtcagatgcatagatttggatcaaaatcttatggcggaaagcatcttgtttgaaatcaactcaaaaaaacagtcagagcttgtcgcttacagagaccggcataaatacgttcaagagctccagactgaagacttatccgtaattcgggaagggaaaataagcatcagaaagaacggtgtatatgttattaccggcggtatgggcggactgggattagaaatggccaagtatttatcatcaaaagaaaatgtccaattaatcctcattggacgctccgagcagcagatcaacatggagaagggaaacaacaagaaaatcgatgctctaaaagaaataaaagaaagcggttctaaggtagattactataaggccgatgtcgcaaatgaaagtgaaatgattcatgtattcgaggaaataaagagtaaatacaatacaatccacggtgtcatacatagtgctggtgtttctggagatgggtttattttcagaaaggaaaaaaaagtgtttgataacgtgctcagaccgaaagttaatggaacatggatattaaacgagctgacaaagcatgagcatctggatttcttcataatgttttcttctatcacagcacttgcggggagtatggggcaggctgattatactgcggctaatgcctacctggattcctttgcagaacgcagacagcgaagaagaccggatgaaaaaacagttacgattaattggtgcggctggtctgatgtgggtatgcttgccgaatatattgaagagcgtcaaaaggccggaaacgaacataaagatgaaaacggctttaagacgattacctcagctgaagcgatacgtgccttcgatgaagtcatgcaaaaggacatccggaatgtgatcatcggggaaattgatcatcgggtactggaattaaatcaagatcaaattcatttccgattatctccggatattttgacttttaaggagcaggcgattgtaaaaaaatctgttgagtcgaaaaccgatcagacatttagcttcagcgatattgaaaataaactaatgaaagcttggataaaagttttaggcttagaacaaatcagtataactgataaattttatgatttgggcggagattcaatatccgcgatatatctggtcaaagaaatagagaaagaatggccttctctcattgatgtttctgatatttttacgtatccctccattaaggagatgtcaacctaccttgaatcccacttcagtgatcagaagtcttctgaccgaatccctgaagaagacaatgaagatgacctggatgcaattttgaataagctggcatccggagagatggaagtcagcgaagcaaatcaaatatttcatccagaccgaaaataactgaattgggcctgtaagaatatattcgcaaaatggatattggcaggctgcgaattgaatgaagaaaaagcagcctgcctatcacattattacgggaactgaattccattttaaggtaaaaatgtagatcttattacccttcctatcaaaaattttcttagaaagaaagcgggagtgatccgtaatgaatagcgttcaatcttatatatttgaacaagtgaaacagcataagctaagccagaaagaagcaaagcgaatgctaaaagaattaaaggctgcaagcagcaatgaagatattgctatcattggaatttcctgcagactgccgaaagcaaacaatacagatgaatactggcagaatctgatgaatggagaagactgcaaagcggaatatccaaaagatatgatcaattacattaaaccgatcgtaaacaataaagggtttactgattttctcggttcaggatatctgacggaagaacaagcagataactggaaacctggcggatatttagaagacgtagacaagttcgatcctgaattttttaatatttctcctaaagaagcaaaggccattgacccgtctcacagagtattgctggagacggtatggactgcgattgaagatgcagggtatgcaggggacaaaatttatggaagcaacacatcgctctttgttggaaaagaccatgtcaataatacgttgtaccgctacattacagaatcagaatcgacaagtatgacgggcaactggccgggtttgatggcggggcggattaattatttattaaatttaaaaggaagttctatggttttggattctgcttgcagctcggggctgcttggtgtgcatcttgcctgtaatgctttgaaaaataaagaatgcgatatgtctattgtcagcggaatttcattaggattctttccgcgcttcaaaacgtccaaaaaatcaatgatggaatcagtaagtgataaagtacactcatttgataaagacgcagacgggacatttttcagtgacggagtagctgcagtcatcttaaaacctttaagtaaagccaagcaggacggagatcatatttatgctgttatcaaagggagtgcagttaataatgacggggcctcaaatggattgacagctccaaatgccatcgcccaggaagaagtactggttcaggcatgggaaaatgctcaaattgatcccgaaaccattcaatatatcgaagcgcacggtacaggcacaaagcttggagatccaattgaaataaaggggatttccaatgcgttttcaaaatatacggacaagctgcagttttgcgggatcggatctgttaaatctaatattggccataccgttgccgtttcgggtttggcgtcacttatcaagatcgttctgtctatgaagcatcaagtcatccctccgagtattaattttaaagaaccgaattcattgattaactttgtgaagtcacctgtatttgttacagacaaagcccatgaatggcctaaaaataactcaccgaggagagcgggaatcagttctttcggctttgtggggaccaattcacatgtagtgattgaagatgctggagatgaggttgaagaggtcattcctgcaaatgaaacatttgagatatttactttatcagctaaaacagagaattctttaatgaaactcatcaaggaatataatgaattctttaaaaaaggaactcaaaaaaacgtaaaacatatttgctatacagcaaacacagggcggggccattacggctaccgattggctctgattgtaaaaagttacgaagaattaaagagaaaaatcggcaggcttgcaggacataacctgaatgaaatatcagaaaaaggcgtatatttttctttccataaagttggttctgatagaaaacagattatggatgaaggagaaatttccttatctgaacatcgcaaaatgaatgctcaatctgacaatttgatacatgacattcttactgaaggggatgaatatttactgctaaaccttacggaaatttgcaacctgtatgtcagaggagcaaaagtagaatggacaaaaatgtacaaggatgagcgcagaaagattgtcagtcttccgacataccaatttgaaagaacattatgctggggagaagtaaaggacagaagaggtcaagcgccgcatcagaaaaatatcagtcacccgctgattgaccagtgtttggctgattcaatgaatgagacgatctattcaacgacatttaatgtgaataaggattgggttttaagtgaccataaaatcatgggggcttgcgttattccgggaacgacttatatcgaaatgggaagaagagcaagtgccgcttactataaaagcaatcaattagaattacgagatattatcttcttcactccgttaacggtaaatgaggatgagaataagattgtacacacaatcattaagaaaaagaaagaatgtattcaatttataatagccagtcaggaaggagaaacctggattacacatgcagaaggaaaagcgtttccattaacagactctgtatcaatgtttgatttagactctgttaggaatgacagtaatagagagaagataaaagtcaattatgaaaataaaaatggtttaatcagcaaagtctttactttcggaccgaggtggctgaacttcaaagaagtcatactgggccctgatgaacaattggccgaattaaaattggctgatgaatttacagcagatttaaaagacgtctttttacatcccgctttgctagataatgcagtgaacgtgtttattggagaagatgatgacgatagtacattccttcctttttcatataaaagcgtgaagatttactcaagaatgccgcagcatttttatgcatttgtcaaaaagaacgcaagcagtaaagagacaaagctgtgtgatattcatttaatagatacagaaggaaatgtttttgcagaaatcaccgattatgtattaaaaaaagtaaatcggattaatgccctttttgaagaaagttctgaatcactttatcaattaaaatggatggcgcaagaagcttttgaagaagaaaaaacagaggtaacaggtcctatactgttatttaaagacaacatggaaatttataaatctatactggaacagttgaaaattcatgacgatgatgttattgaagtggagtttggggatgaatttcagaagataaatgggcggaaattcctaattagcggatcagaagaagactatgttcaattattgcatagcataaacgatcaaaatatcagcagcattatacatatgtcttctatcagccgccaaggaacggaatcattaacagatttagaagacatgcagaataaaggcgtatacagcctgttccgcttagtccggggattaagtaagaataagatgaaaagcaatattaatttgcatcttatttctgaacttgtgacagaagtgtccggagaagaaaatacaatcaatccattgggcgccgcgttgtttggtctgggacgtgttatttcgcaggagttccaaaatgtttcatgtaaagcaattgatattgatgaacatacttcaccggaaattattagtgaggagttaagaacaaaagggaaacactatcaagtcgcctttagggatggtaagcggtatatcagtcggttggatacggttgaaccgataaaggataagaaacacggcggtatggagattaaagaaaacggtgtctatatgattaccggcggcaccggcggaatcggtttggagatcgcaaagcacctggctggaaaacataacgtcaatgctgtattgctcaatcgctctaaactgcctgatcaaagccgatgggacgatatcattgctgatggaacggatttaaagctttgcagaaaactgaagtccatcagagctatcgagtcaatgggttctaaagttgattgctacagctgtgaagtttctgacttaaacagcatggagccggtaattgaagaaataaaacagaaatacggtacgatcaatggcgtgttccattgtgccggagttgccggggacggtttcctctttagaaaagaagctaatatttttaaagaagtgctcgctcctaaaattaatggaacatgggttatcaatcatttaacgagagacgtagatttagatttcacgattttgttctcctcaattaattctattttcggaggtgccggacagggagattatacagctgcaaatgcttatttagattcctttgcttatatgcaaaacaaacaggggaaaaacacgctgtcaattaactggccggcttgggatgaggtcggcatagctgtcgattatggaattactgatgagagctctattttcagattattgacggtagaaagggctatttccgttttagaagaaatagcatcgaataagcttactaatatcattccaggtacattaaatatgaagctcctcgcttttgcgaaggatgaattgtcttttgaattatctgagcaaatcaaaaacaaattaatagataaaaacaggacaaaaaacgaagcagaaaaacgtcgaagaacagatactgaagatatagtgctgaaaggaaagggagaactttactctgataccgaaaaaagtattgcgcaaatgtactctatggttttggatatgcaagagctggatttatatgaaagctttagtgccatgggcggcgattctattatggcaacccaactgttaaaactgataaatcaacaatatcctgacattgtggatatatctgatatatttacatattcctctgtagtggagctatcagagtatattgacaagcagctgaataaagatcatcagcaagaaacggaagaagatactgctgaaaatcggcttgagcaagaactcaacaatctatttgacgacctggagaacggcaaaatcaatatacaagaaggattgaaaattctagaaaactagtttcggaaaaggggaaaattaatgaagaatacagaagaaaacaagactgcaatcataatcggaggcggtattgcaggaatggccgcgggctgttacttgcaaatgaacggatacagcacgaaaatttttgaaatgggtttgctgccgggtggtttatgtaccggctggaagagaaaagggtacttttttgacggttgtatcagctggctggtcggttcaggacctaacaataccttccataaattttggaaagaactgaatgtaatacaaaatatggaattcattaatgatgaagaatttgcggttgttaactttagaaatggtgatacatttacgctgtatgctgatgtagataaattagaacaggagtttttaagagttgcacctgaagatgcggaaacaattaagcttttaactgatggcattcgagttgtttctgatgtagagctggatttggataaagcgcccgaactgttcgatttagcagactttgaggccttcaaagcaaaggctggcccttacatgaaagtaatggggcaatggggaaaagtgacgatcaaagaattcgcccagcgctttaaaagcagttttgtaagagaaaatgtaaatcgtctgttttggtttaatgtagatacccctatatcttactttatggctactttaggctgggctaatagcaaatcttcaggacatcctgtagaaggttctctgcaattcgcaaaaattattgaagccagatatgttgaattaggcggtgagattcaatataaatcacctgtttctaaggttttagtagaaaatgataaagcgatcggaatagagctgaaaaacggacagtgtcattatggagatatcgtcatttcagcagcggatggctataaaactatttttgaaatgctggatggaaaatatacagatgatgaactgacattttgttatgacaaccttaaaacaagtgcaccgcaaatttatgtcggattgggcgtatcaaaaacgtttgaaaaatatcctcattatttgagtctggaattagaacagcctcttaatgcctatggctgtgacaacgttaaaaacatatttgtgaaaatatataacgaaaatccttcattcgcgcctgatggcaaaacgagtattatcgtgtatgcgaaaacttctgctgaatactgggagactttgcaaaaaaacaaccgcgaaaaatatgaagaagagaaaaaagcaattgcgaatgtaatgattgatgaattagacaaatggtttggtgaaattaaatcaaatattgacgtgactgatgtatccaccccatatacgatcagaagatacacaaataatagaaatggaagctggcagggctgggaaaaacagatggaaggcatcatgcacgagaaaaaactgaaacgttcacttcccggacttaaagacttttatatggttgggcattggagtcaagtgggaggaggtcttccgagtgttgtcttacaggccagaaatctggtgcaggtgttatgtaaagaagatggaaaggtttttgagacaaaaattaactaattcaataagctgcttcaattgaagcagctattctatatatccatgatgcttctcatattttatatagaatcaaaatcgataggggtgattaatcgtggatgatatttcgattataaaacaatatgtattggagcaagtaaaagagcaaaaaatggacagggaaatggctttgcgcattttaaaaggattatctgataagtccaagaaaaatcaatgtgatattgccattatcggcatatcctgccgtttctcaaaagccaataatgcaaaagaatactggcaaaacattatgaaccgtgcctcatgcatccgggacttaccggagaagcggcggaaagatattgatccattgctgcccagtgcgaatgagaattcttattttagagcgggattcttagatgaaattgataagtttgattcatcatttttcagaatttcgccaagagaagccatgcttatggatccgaaacaaagattgtttttggagacagtttatcacgctattgaggactccggttatgcggggaacaagttacaaggttcgaatacaggtattttcgttggacatgatcatagcggtgacttgaagttttcctatgcttccctagtaaaggatgcggatatgattgcaatgacgggtacttatcccggcatattggcaagcaggacctcctacatttttaatctgaaagggccaagcttggttgttgatacagcctgctcttccggactcgtttcggttcatcttgcttgtgaggcacttaaaaatgaagaatgcagcatggctattgcgggaggcgttaatttatttctgagacctgaaaatataggtacgatgagcgaaatagaagcggaaaacgctaaaatcagcatttttgataaaaatgcaaaggggaccgcatggggtgaggggatttctgctattgtattaaaacctttacatagggctatagaagacagagaccacatatatgctgtcattaaagggagcgctacgaataatgacggggcttctaacggaatcactgctcctaatgctgaatcacaagagaaattgatttcccgtgcctggaagaatgcgaatattagtccggaaactatttcttatattgaaacacatggaacaggcacgattttgggagacccgattgagatcaaagggataacgaatgcgtttaagaaatataccgataaaaagcagttttgcggtataggttcagtcaaacccaatatcggccatacagtaggggcatcaggcatggcgtctctcattaaagcatgcatggctttaaaagagaaggtcatccccccaagtatcaactttaatgaaccgaatcctttaattaatttttcgaattcacctgtttatgtgaatgacatgataagaaattgggaaaaaggagagacgccaagaagagccggtgtaagttcgtttggcttcagcggaaccaactgtcatattgtattggaagaagcacctgaaataataggtgagactgaacagagacaggtaaaagaggtattcactctgtctgcaaaaaataagtccgtcctgaatgatatagcatcaaagtatcttcattttatctcggaagaaaacaatttgaatctctctgatctttgttatacagcgaatacgggaagaaaacatctggagaatagagtgtgttttctcgtaaaagacatcgaagatatgaaggaaaaacttgaaagtctgctcgaagcgccggttcagcaagaagaagctgcattttcttataagaccgatagagatctaagtaccgctgctggaaaaaaacttaaggcttataatgcaggcgggagaacagatgagagtcttctgattgatataagcaagctctatgaaaaaggtgcagagattgattgggaaatgttatatgaaggagaaaaaagaagaaaaatcagcttgccgggttacgcatttttgcgggagagacattgggtgaaactgcctgaaaaattaccgataagcaatgcaccagataacccttcagtcaacaagcctcaaataataagactgagtggcagggaagacggctgttattcagaaacagagctaatggcaggacaaatttggggaaatgcccttggaatcaatccgatcgatgttacatccgatttttatgaaatgggcggagattcaatcatagcaatagaaatcatcaactttatcaataaacagcaaggaacggagctttcagtttcagacttgctaaagcattcgaatataaaactcttctcagcttatttggatgaatattctctgaggaagacaaatgatgtgaatgtgattcccaaagcaggcgatttagagtggtatgaggcctcatctgcacagaaaagaatttttattctagatcaattaaataaaaacagcacttcttataatatcccgttctttttaatgattgaaggagagttggacgataaacgtttagaagatgcgtttaaaaaattaataatcaggcatgaggttttaagaacgtccataggtttaagggacgggcagcttgtgcaaatcatagaaaaagacgttcgatttaaaatggatagaatcaagacctccgaagaagaattagagagccttatgtctaattttgtccgcccgtttgatgtagaaaaggctcctttactgcgtgcaggattagccgagattagtcatcaaaaacatcttttaatgatagatttacagcatattatagcggatggggcgtctatcccgatcttccaaagggaattgataaatttatacgaaggcaacgaactgccgtcattgaacattcaatttaaggattttgcgatatggcaaaatgaattatttcatactgaagaaatgaaaaaacaaaaagatttttggttaaatgagtttaaaggagaaattcccgttctcaatctgcccgcagatttttcaagagaagccgaacgagatgatcaaggtgaacgaatctatttttatgcaggaagagagctgactgccaagttaacagaattaaacgcaaaacaaaaagtcacccttttcatgactttaatggcttcatttaatgtgcttctccataaacttactggtcaagaagatattattatcggcacacctgtagccggaagaaagcataaagaattagaaaacatgataggaatgtttgtaaatacgctggcactgagaaataaaccatctgccgacaaaacattcaaagaactgcttgaagccgttagggataatgcgcttctagcttatgaaaatcaagattatccttttgaagagcttgtagaccatttgaaccttgagagggatataaaccagaatgctcttttcaacgttatgtttgtccttcagctgatggataatccggcaattgaagtaaatgggctgaaatataagccgtatctttatgaaaacaaaacagcgaaatttgatcttctgcttcaagcatttccttcaaaagaggatatcaagtttgagttcacttattcatcaaacttgtttaagcgcacaactgtagaaaaattctcacagcgattcttaatgatcctcaatcatattgttgaaagtcaagatggactaatcggggagattaacattttagaagaaaatgaacgacgcgaaatattgagttacagtggaagatcactgagaagcagaggcacagatgcatctatctgtgagctttttgagaagcaggcggaagcaacgccgaatcaaatagctgtgtctgcacaagacggaagcttaacttatagtgagctgaacaaaaatgcaaaccggcttggaagagcactcattcaaaaaggtgtcaaaaagaatgaagcagtaggcatagctgcagaccgaaccactgattttatcatcggaataatgggaattttaaaagcaggagcagcttatctgccaattgatccatcatatccgcaagaaagagttgagtatatgctcaaagacagcggggcccgtttgttactgacggatcgcaacaatcatggtcaaaggtacggagtagaaagtgtttgtctgaatgaattggaaacagttccagacgacgggaggaatgttaaaggaggaacggaagggcatagccttgcctatatcatctacacttctggatcaacgggacacccaaaaggtgtgatgatcgaacataaaagtatagcgaatttaacagaagccctgcatgaacgtatctactgcaaacatggcgggcagcagaatgtagcgttgttggcacccttttcttttgacgcttctgtcaaacagattttttctgcactgcttttgggacactctctttacatcgtctctgaagaagccaggcatgatatcacgaaacttgctgaattctatatccaaaataaaataactatttctgatggaacaccagcctatctcagcctgctctctgagtctccgcagtgtggccgtataggtgtaaaacattttattataggcggcgaagtgcttaaacctgaagaagtaaagcgtttctataaagtatttaaaaagaatgaccgtccttatataacaaatgtatatggaccgacggaatgctgtgttgatgctgcagcttatacgataaaccaggataatatttccaatataaagagaatccctatcggcacaccgataaaaaactgttctatctacatactagataaacagcagaagcctgtgccgccgggagttatcggagagttatacatcggaggggaaggagttggacgaggctattgcaatcgtgaagaactaaccaaggctaaatttatcccggatcttgttcattctggtgagaaaatgtataaaaccggagatttaggcaagtggaatgaggatgggaatatagaatttgccggaagaatcgaccgacaagtaaaaatcagaggatttagaattgaactggatgagattataaacagactgctgtctcaccgcaatgttcaagaagcggttgcgattgctcacaatgatcagatatatgcctatacagtatgtaaagatacgcagccgccttctcagctaaaagaatacttattggaatatctgccggaatatatgatcccgacagtcattattggcatagataaaattccgttgacgaacaatgggaagactgatgtaaaacgtttgccgcttccagctgaaaataatgccgagctgcatcactttattgctccgagaaacgagattgaacgaatcgtcagtgaggtttggtccgacattcttgaagtttctaaaatcagtataaaagataactttttcgttttaggcggagattcaattaaagccatacaagcagcggtcagaatggaaaaattcaatcttaggctggaagtgaaagacatctttcattaccagacaatcgaaggagtttcgaataaagtcagttatataacagcggcatctgataacagtgtgataacgggagaagcccgtcttgtgccaattcaatgctggctggctgaaagccataatgatactctgcaccatcggaatctttcttttatgttatacagggaagccgggtttggcgaagatattgtaaaagacattttcacccggattattcagcatcatgacagtctgagaacagtattcaaacgtaaaggcgatagaatggtacaggtaatcagaggcctgacggacggcgacttgtttgactttcatctgatcaatgcaataaacatgccgcaatcagttttaaaaatgaaaataaatcaaatacaagccagtatggatctgactcacggcccgcttgttaaattggcactcattaaggaagcagatggggaacatctgttaatcgtcattcaccaaatgatcattgatcatatgtcttggagaatactgcttgaagattttaatacagcatatcagcaagttaaaagtaacgaagacattgtattaccaaataaaaccgattcgtatttaaaatggtctgattatctctataaatatgctgaaagtgaacggctgttgtttgagaaagagtattggacgaaaatcgaaaatgtttatgctccgtctattccggttgatattcaggggcaaattgccaaagtcaaagataacagacaagtgtacaggcagtttaatgttcgggaaactgaaaatataatgaatgcgattcaaggacaagatcatttcactattgagactgttttgctcacagctttaggtttgacagtaaaacatcaaacaggcagtaatacatctctcgtgcacttaggcaaccatggccgcactcatcagagtgagaagcttaatatctacagaacagtaggcagattttctgcaatctatccggtggctttggaggtctccgattctgatcatatcggttcgagtttagataatgttaactcgaccttagccaatattcctgatcaagggataggatatggtattttaagatatttaaaacaagatataaaagagaaatcaaaaccagacatttcatttaattatatgggcgaatttgataatgaactgcacacagaaagctttacggtatctccgctttcaaccgggaatgatataagtgaagatgaaatttggaattacaagtttaagtttattgtgttggtaagagagaaaaaattgagcattggaattgaatataatcaaaatcagtactataagagtactgtagaaaatctgctcaatcagtatatgcgttatatcaaaaaagcagcagaaaccatttaattaatcggaggttaacgtaaatgaccaattcagttcagcaagataaacaagtaccgaagaaatatcctcaggccgcagtcatgcaaatggtttcagggctggggttttccctggcagttaaaacagcggtagaattggatgtattttccgcttttcaaaatggaccagcttcagcggaagcgatagctgaagcccttgaattgaacccctctgccttattcaggctcttaagagcgctggaatccgtcggtttggtcgcccaagctcaaaatggctattatgatgtaacagagtatggtgccactttgatgcctgggaaagcaaaatccattgagcctttggtagaatatctgctgcatgaaacagtagtgcagtctatgtttaaaatggattatagtatcaaaaccggcaaatccgcttttgaagccatttatggtgataaatggtatgagaataatagtcttgatcaagattacttaaaaacaatggataaggcgatggagatttattcaaaaatgagtctgccatccatattgaaagcttactcatttgaaaagtttgatgttatcgtagacgtcgcgggaggaatgggccagttaataacaggcattttaggtgtggctcctaaatcaaaggggatattgtttgatcttccaaaaacgatacaaagtgcaaaaaagcatttagcatcttcagagatgagcgaacgctgtcagtttacggaagggagtatgtttgaggaaattccttccggcggagacttgtatgtgataagcaaagtgttaaacgattgggatgatgagcatgtggttgctattcttgaaaatatagccggtgccatgtctgatcattccaagctgattatagttgaaaatgtgcctgaagcagacaggctgtcccctgaagaagcttttcgtgatttattatttttagtatgttctgcaggcggcagagtcagaaagaaaaccgagtttgaacaattgattgaaaaagccggattaacactattaaatgtaattcagaccccgagtaaatacacaattttggagtgtggaaagaaataatgttatataagctatctcctttaggagatagcttttttatataaaaagttcaccaatttgactgattgattctgtctatctattgatttctctgataaaatgaaacttataatatttaacataattataaatttgaaccacaaggaggaagaaacatgaaaaaaagactcgttatgctatttgccgcggccgccgctgctttgttgcttgtgagcgggttgtgggctccgtcagcgtctgcggcgccggctcctgctttaacacaaatccgtattatcggtgtgacgtctgacggtcagaattaccaatgggaaaatatcggtccgaaccaaatcagcgcatcaaaaccgatgaaggggacaacgggttatttagccgtatatttccaagggtatccgaacaataatacgatccaggcgtttaacaacggaacgaatattacaaatcttacgtcaaaagcgctggaagatgaatatacgaaaaacggcaatatcgttacaggctatattaaatattacagcgttcctctttcttatgtcagttcaggaacgttctctttctccgcaacggggctgaacgggccgtacacgccgttaagcagcggatttttctccattcaggtacagagttaaaacagccgcccggtgctttcatgtatagttttcctctctttccgggaagctattcctaaagaaaagggagggcttacatgatggacaggacactcggatatttgcgcgagtcgctttcgaaccacttggagcatgatgtgtgccgggggatttataaaaagcttcaggtgaagcattatgcaaatgagggcgagttcgtgaaagatctaaatgatctggaaatggatgcgttgaatcaggtgcttgaaaaggaaatcaaatatgctgagaacgagcaggatgagaagcgcacgatggaattgaatgaagtatatgagcttctattttaaagagcctcccggcggccgggaggctttttattgtttcggaaccagtttacagaatcatccaaccctttgtataatggatagttgtgaaaaacacagacggaggagaaacatgaacgaaataaaaaaacagacggttcttgagttgtcatcggttgaaaaagctttggtttatctggtgccgccattattggggctggtcatcggatggtttctgccggtcattgcgaagtgggccgtaacattggattggctgccttttcacgggccgctggaaataatcgcttcctttcacggatggaaggctgcggctgcaaccgccgttatcggcttaattgggggagtgtggctgacgcgggcagcttttaaagaaagtcttgtggcagtcgtgacggacagcgaggtgtccttaaccatatataatgaagaaagcgtgttttcgaaagacagcatttccggtgtgtttacggatgggaagtatcttgtcttattaggcactgaaggacaggagctttttcgggagaagcttgagccggcggttgaaaaagcggctgatgcgtttcgcgcgcatgggtatgtctggctggggacggaagatccttttaaagaagaatacaaacggtgggtgccggacacgccggatttggagcctggggcaaatgctcttttaaaagcgagagaaaaggcgctgaaagaggaggaaaaggctgatgcgaaagagctgaaagcggaaatatccaaactgggcattaccgtgcgggagaaagggtcgcgccaatattggcggatctataaaacgccgtctgcataaaaaaagctgccgccgtttgatacggccgggcagcccgggaacagattatttcttcttgtcatcataatattgaaccgggtacatggagccttcggataccattttgttatcttcaatatcttcgggatgcgggttgcctgctttgttgacggggaatgattcaatatcctgcttcccggagagcgatgttttcatattgcggataaagttcatcaccttttggcggtttgatttatctttgagcaggtaggaagtcactccgacagtcgacacggcaagtcctgaaatgagcagtttttgtttcacgataaaaactcctttctatttctggcttgcagtagttattcccgcttaacggctgtttaaacatcggaaggttaattttggcttgccgctttaatgcgataaagattgacaaaactattttcagaataatattataaatatatgatagcgctggagtcatattttaattgaaaggtgttaactttatgaatcaattacatcgcagaatgggaacgtttgcactcatgatggtcggacttgggtcgatgattggctccggttggttattcggggcgtggcgggcggctcagattgcgggacctgccgcaattatttcctggattatcggtatgatcgtaattttgtttatcgcactttcttacagtgaattgggttcaatgttcccggaagccgggggaatggtaaaatatactcaatattctcatggatcatttattggatttatcgcaggatgggcaaactggattgcgattgtttccgttattccggtggaggcggttgcgtctgttcaatatatgagctcatggccgtgggactgggcaaagtggacaagcaatctcgttcacaacggcacacttacgggagaggggctcggcttcgcatccgtattgctgattatttactttttactgaattattggacagttaacctgttttcaaaagcgaattcattgattaccatctttaaaattattattccggggctgacaatcggagcgctgctgtttaccggttttcacggcggaaacttcacatccggttcaagcattgcgccgaacggctgggcgagcgtgctgacggcggtggccacatcaggtatcgtatttgcgtttaacgggtttcaaagcccgattaacatggccggagaagcaaaaaatcccggcaaatcgattccgattgcggttgtcggttcgctgctggtcgcaaccgtcatttacgtcctattgcaaatcgcatttatcggtgcggttgaaccttccatgatcgttcacggctggagtcacctgaactttaactctccatttgccgatttggcgatcgcattgaatatcaactggcttgtcattattctttatgcggatgcgttcgtatctccgtcgggaacgggtatcacatataccgctacgacgtcacgcatgatttacggcatggaaaaaaataaatatatgccgagcattttcggaaagcttcatccgctgtacggcgtgccgcgccaagcgatgattttcaacctgatcgtatcgtttatctttctgtttttattcagaggatggggcgtgcttgctgaaatcatttccgtagcgacgctgatttcttatatcacgggtcccgtgacggtaatgacgctgcggaggacggcggcggatttgtacaggcctctccgtctgaaaggactcagcgtggttgcaccgctcggcttcgtgttcgcgtctctcgtgctgtattgggcgcgctggccgttaacagggcaggtgctgtttatcattttgatcggccttccgatttatttctactaccaagcgaaagcgaagtggagaggattccgcagaaactttaaaggcggcgtttggatggttgtctatctgctcagcatgatggtcatttcatggctcggaagtgaaaaattcggcggtctgaacatcattccgtacggatgggatatggggctgatcgcaatcgttgcccttgccttctatgcgtgggcgctgaagagcggattcaagactgagtatttgaaagacgccaaagcaatcaacgatcaattaaaaggcgggcaggcggaagccgctgccggaaaagaataatgattgataaaaaccttgcggtaacgtttccgcaaggttttttgatcaggcaaaaaaacatgggttcggcatcatctccgaacccatgctggctttatgatttatattcttttttaaccttttgaaatatatccgcatagttggtgaacacaccggttacgccccaattcagcagacggcgcatgtccgtctcgctgttcacggtgtaagggtgaagcagtaggccgtggctgcgaatgtttcggacattttgagcgttcagcgctttgtaatccggtccgattccgacggcatatgttttgatgtctgttaaatctgcgtcagtcattgaggtcatctgttccgcttcaagcaattggacggcgggaagtttcggatcgagctgtttgattttcagaaggctctccctgctgaaagactgaatgataacttgtccaagtttcgcatgcttacctgccagtttgtattttttcagtgaggcgatcagtttttcttccatacccggatatgtttcaggcgcctttgtttcaatataatagtttgcatgtctgccgaaccgttttaacacgtcatcaagtgtgggaacgcgaagtccggcgtattgcggttttgctttttccggataggccttattgaaccaagaaccggcgtcgagcttttgaatctcggctaatgtatgatccttcacccagccttgtccgtttgtggtgcggtccagtttttcatcatgcatgacgatcagcttgccgtcttttgtcatttgtaaatccagctcaatatagtcagccttcattttttgcgcagtttcataagaaaggatcgtgtgctccgggacataccccgaagcaccgcgatgggcaatggttaaaattctgtcaggagacaagaggtttccttttcccgccgccgatacaggcgtgacgatgaatgacaataaaccgaatgaaagcaataccaaagcaaacaacttatgtttccgcatgttttcttcccccttaaaaatcaatatctgtctctagtgtagaaaatcgttgtaaatgctgtactgcaaaaatattaatcttttatgttgttttcttacacatgctccgcccgcttgcctgtattccacgtcatagccaagaagacgatggacagcacgcatgaggagataagcatgataaagccgccgttccagtcaaagcggtctacgacataacccatgatggcgttggcgaaagcagagccaccgatgtagccgaaaaacccggttaagccggctgctgttcccgccgcttttttaggcgcaaggtcaatggcctgaagtccgatcagcatgacaggcccatagattaagaatccgatgctgatcagcgcgatattatcgatgagcggatgaccggcagggttaagccagtagaccaatacagcgataaatacgccggccatgaacagcacgccggccggtgcgcggcggcttttgaaaaatcggtcgctgatccagccgcacaaaatcgttcccggaattcccgcatattcataaaggaaataagaccatctggaatcttcaggagagaaccctttcgcttccgtcaaataagtcggcgcccagtcaacgacaccgtaccgcacgaaataaacaaagacattggcaaatgcgatataccacagaaatttattattcagcacgtatttgaaaagaatttctttggtcgtcatctctttttcctggtctttgaacgcatgtttcggatagtcattccggtattcttcaatcggcggaagcccgcaggattgcggcgtgtcccgaacgagaagaacaatcacaaatgaaatgacgatggcgataatcgccggaaagaaaaatacgcttttccaagtaacaaacatggcgatgccgagagtcacgagcggggcgagaatacctccgcctatgttatgggcgacattccatatcgacattttcgttccgcgttcactgatggaaaaccaatgagccatcgtccgtccgcaaggcggccagcccatcccttgaaaccatccgttaataaacataaaaatgaacataatcgtcacgcttgacgtgacccatggcatggaaacaaataaaatgttgacgacacctgacaaaaacagacctgtcgcaaggaaatacctcgggttgcagcggtcagacaccatccccataataaatttgctgaagccgtaagcgattgatacggccgcaagcaccaagccaagttccccttttgaaaacccttgttcctgaaaataaggaatagcgaaggcaaagtttttgcgaagtaaataatacccggcatacccgatgaaaatccccaaaaatacctgcagcctgagccgtttataggccgcatccgtctttgaatcatccaatctctcaatatgcggagccggcttgaacaattgaaacatcatatcctcccctttgctgaacgtctatcatgatgtatgtatgactcctttccttgaaaatgacaaaaagaaccagaaatcacccttatgaaagggcgcggtttcctggttctcctcatctccatccaaaaatcattaacttgtatatgatagcgctttcttaaattatcacagtctggcgtgaatgtaaacgctttaaggaaagttttcatttttttgaataaataaccggagggaatatcagccggagcgcgaaagatttgatgtactcgattttgtactcaggcataagatgtgttaggccgaactaagaaaagcgaagggagtgcatctgttgattgatgagttggattttgcgttcggtgttctgccgctttgtatcatcatcctgtcagtcgccggaacgtacctgtttaaaaacgcgttcattatgccggctgccgctttggccgtttgccttatatgcacctttaccatattgaatttctcgtttatcgggtgggccgtcgtgtacacgctcgtctctttcgcgttatcgcatattacgatggtggtgatcagccaaaataaaaaataggatcggcggcagccgatccagctatcaaaagcagagatgcgttctctgctttgttttatttatgaatgtgcaggaattccttgatgaccgcggtctgttcttctttcggatagcttctgtacagatggctggctaagcggacggggtcaccgaagaagtaccgctcatattgtgtctgccttgttccaaaggggctcatggtcaaatcccatgcgaggcggaacacttttacccggtcctcagcgttcaattcggccgcctgtaaatattggtcaaggtctcctctgatgtcggaacggaacgctttttcagtcggcaaagtcaccattccgcttgccccgatcagctggatgatttccgtgaagcgcgggtagatgtcagggaaaatcgcgctgaccacgcgaagcggagtgacactcggacgcatataaccccattcgtctgtttccgcatcattctccgacttttccaaaagggctttcatcgtttccagaccggtgatgatctcagccatcttggcctgaatatgctgatattcccccacatctatcgcatcgacaagcgtctgggcgaggcccaggagaaactccgtctttacaatttgtctcgtgataacttgatgaaatgcgaaggcgttaaaagagcttttcatattaaaatcaaaagccgcctcgtaattattgtaaaaaaatacgcgttcccaagggaccaaaacgtgatcaaatacaacgatagaatccatttcttcatatcttgagctgagcggataatcaaatgatgattttccgagtacgaaagattccctgcagatgaattttactccttttgtattggaagggattgaaaaagcgaacgcttcatccgattcaaaatacatcttaggcagagaaaccacgagcacttcatccgtcaggccgccttgtgtggccaaaatccgcgcgccgtgtatgataaggcctttttcatttttatcgacgacttttgccgagataggtgtcggcgatacgtttacacccatttgtgaacgattcacctgaggggtgataaacgtgtgcgtaaaagaaagatcctgtgcggcagcgcgttcgtacagcgcttgaacatgttccggaaaacaatgatcacggtctttcaaaagcgcggcagaggaggcgaagctcatcagcacggtattcatataatccgggcttcgtcccatcattccgtgcgtgtgtctggcccaatgttcgaacatgtttcttcttctttttacgtcttctttcgttttcggctgcaggtatgaaagcccggcccgttcttttttaccgggaagactgtaagtcatttgatctttcatgtccggtttcgtttgcaaatcataaagagagcgcttcgtttccagaaggcccttaaatgcgggatgttcagaaatctgtccctcgatcttttcaccatcaagccaaatctcatttcctagctgatttaatcggtcaatgaacattttgccattaatgatacccatcatgtcgcccttctttctttgcagatccactacctcattatattgaaaacgaaattgggtgttccggttatttccaaaggggaagagccttttttgataaggggggtgaagggattgcatcataaaaaaaccccttaagcagaggggtttttaactgatcatgtctttgtatcgttgttcgaggacaaagtctatcattccggtgatacgggtgttttcagcgttttttgtaaagtgaggaatggagtgcaaaggccctttttggtacagtttcagcagttttattagatatattaagcccctggcgaataaaaaaagcaggagatacggaaataggcggggaacttgaacatagctgacttgacctgagaaaagtgcagtcagaaacatagcaataatgcttccgataaaaatccatttcataaaatcaaataatgagaagtcaggtttggaaaactgatttttcagcttgaataacttctcagtatcttgttcttcaagacatttcatcagttcttcatcatttttacaagagttaatctgcttcatgctttcttcgagtgtatcatcactttgtttaccgcccgttaaagaagccagtgtacgatatttcttttccagatttgtatttatcatatttataacccggaaggagtaagtgtttcttcttaagcggctgtcaggtaaccggtctttcttttcgcgcaaaaaaaacatataaaatgcgacaatacatccgattgtaaacagtgaaaacactgccggcaacagatcagataaaatgggaacaggtatgagtgttttgacttgaataaacaagaatgaagtgaagatcaacgccattgctatacagcaaaaagcaatcttcatgagcatttgaaaaggaagagccggggcagagtaatagtactttaaaagactgagcgtatgtacatcctgttcagataaaaagtccatcatttcttgttcattcttacattttaacaatctttgtgcagtttgctttgctgtgttaaatgcggattgattttcattcaatgagtgaaacctccaaaaaaataataggaataaaactgcatgaatatcttattcatgcagtttttctttgattagtagagatcagtcatataagcgtaaagggctagtaaaactgctgcaaattcagttacagcttctactgttttgttcccggtcggtttttcagtaaggatcttagaggtgaaatagaaagcagacacccctgcaacaataacgagagttgaagggagaagatcccagtccttcgctaattcactttctgcagctgaaaccggtacacctttatacgttttaattctaaacgtaaacatggtcgtaagtccagttgtggatccatcggcaactggaatgtcaggtgtatagattttaattgaaacatctaatgattgagcagaaggggtcactgccatttccagataaccgtttcttacagataggctcagattgtctaataaattttgataagaacggatgtctgaagccgtaagtattgtttgtgtatctcccagtaaaccagtaacatatgccccgggctttccatttgttattgtcattgtattagcagacccctcacttgggatcgtatacagaattgaagtagacaataagatatctaaagttggggaagttaaaatggtttcggttgtaccgaattcgaacatcatattggcaagaccggatatattctctaaatccggaattgttgacaggatattggttaatgtgtttagtcttgcatcatacacaggatcagaaggcggatggacgctgcttgcacccgagtcttttccggagtatccgtctttgtcaatggcgacttttcccgctccgcttccgatcgttccttcataaaattgatcaaaagcccagtttttcggcatcgggtatccgaggttgccgctgaatccggtcgacatgttagccgtaaagctatatttggtcagacctgcttctgacgtccggatacaaatgtttctcggtccgtataccccgatttcatatttcggcgcagttgagaacgcctgcattttcataaaggctgacttgatttcttgaaagtaagggatgattttatccgtgacttcataatcatacgcatcaaaatcgacggcaaagtaaatggtcgttcctgacggaaaacctaatcttcgggcggctgatgcagcgctgtacgcatctctcgttccttggtcttttacaaaataagaagattcatagccgccgtcctgataaatcggaaacacgcttaagccggcattgaaaatcgcggaaagttcttttgacgttaacgctttcgatgtcagtccgctgctagtccgcacattcccggtcagatatcttcccacgatcttatagccattctcacgcaaagttttagccgtatctgccgtcaaaatggcagcggtgtcacaagctgaagcagcccgcgttgtgtcgcctgagcttgataataaagctttaatcgtcggcatgtccgcataacctgtctgcggcaggcacataaattcttggaaagctttcactgccgatacaactccgacgccgtattttccgtcgaattcaccggggtcaaatgatttcccattacagtaaagcgcgtattgaacaatcaaaacaaagcctgtccgtgaatcgccgggagtcaaggtaggacataagctggtcgttccgttcccgaaaaatccattggcgacgcttgtgctcatgccttcttctttttgcagagcatagatgagagccttgtttgtatcgcgggcatataagccgtcacaaggcatcaagccgatgtagtcattgtaatcccggttcaggttctgctggatttggcggattcttttgtcgcctcccgctactaaccgaaaagcactcatatccagcaaagccttcataatgagtgccgtgacgatgccgtcttgcttagtaagtccggccgctttttgaaactcttttacagcgctttcggtattttcatagaaaacgccagaaaatccgcccgggttaaatcctttacaccacagcgccccctgcagaatgtaattcatgtttgtcggcttagaatcgggagcctgctttttcagcggtttaaacaatctttgtgtcgtcggtccgaagttatcggcgggttctgaaataccgagctcaatttgaagcgcccgtgtcagaccgtaaatggtatcccagcctgtttttccgttttccggcaccttgttgtacccgtgtctgcctttgtacgtctcattcagccattgttgtgtttccaggaccatttcgtccattgcaatccctccattacgtgtagtgtgcgttcattcataggtggcaaacgtatgacagtttgtcatgggcgcaggagtttgtccgagggcatccccatcatacaaacgccgatagagaggcattgataggtaaagatctctctatgacaattgatacaaaaacagcaaaatggatagcgctttaaagtaactttatcacttaatcaaaaataacaagaatcataagtattagtcatatagtcattttcagggctgttctcatctcttcctgcaatcaaaatggttagttggacggatttatgattagctatattgtcattaacataaatagggtaaatagttacaggaaggaaggattttctcgatgaaaagcaaaaagatttttaagtcgctcatcattatttttactcttttaatcagcggaattggttttatgggtttttcttctccgcaaaaagcagaggctaaagactggcttcatacttataaaagcgggtatttcactaactatgtgatcaatacatatcatcctaaattcactaagacgacaaaaaagtacagcttgagagccgtcacttttaaatccaacagtaaagggaagggcacgtataaaatatacgttcaaaagcaagtcaacggcaaaggtgcctggaaaacaatcaaaaccgccaatgcaaagaaaaatggaacgacttattttgaaacacctttgttaaaaaaaggagattcataccgatttaaaatggtcaatcaaggttcgaaaaaacgtgtcaattatagtgcgagttggattgtattcgcttcataattttgattttcagcttataatgttttagctgccgcagctgcggcagctttttattttctccggagctcaaccgccagggagcccgcacctgtctcttcgggcgtacgtttgtattcaccgcatcattctggattatgcggaaaggtacatcgcttcaatgaaaagccgatcccgggtccttttgatttgtttgaaaatgttctgatataaaaaaggcgtgccgcggtgtaaaatggctatattgataaaaatggaggttgagatggatcaagattatatgactgagcttgtctcagtccagctgaagaaaatccggtcggagagaggctacacacaggagaaaatggcggatgtgatcggcctttctaaaaagtcgctggtgcagattgagaaagggcgggcgcttgcggaatggccgcacgttgtggcggtttgcgcgcttttcagatcaagtgaaacactgcaatccgtattaggagatgatccgctggaggtcattgaaacggttgctcaccgcacaattgacaggccgaaggggaagacgatgggcggcaaggtgtggtggaaagccatcgagaaaaaaggcgagttccgcttgcagcagcatttgatttcccaccattaccgcatccttgattcttatgatgatctgtggttcagcagttttgaaaaggcagaagctttggagcggcttgatgagctgtttttggaggcggaggaagcgaagcgctgacgcacctccggttgatgtattttctgacaagtgagaaaatatgtataaattccagccaaaggagagattcgaatgaagcctgaagatatcgtccgaagcggcccgaatcagtacatatgcaaggaaggaatcgcaaaagaacttccggggctgctggagacattcagaaaacccgttattgtgaccggaatcaaatcttatcaggcgttctccgattacggcggcggttcttcctgggatgtgattcagcacaaaggatactgttcacctgaggcggtgcgtaaggtctgcgggcaggcggaagacgcggatgtgatcatcggtatcggaggcggcacgattttggatttggcaaaagcggcggcagaccggcttgatattgaggctgtgatgcttccttccattgcggggacgtgtgcggcaagtacgccgttgagtgtcatatatgatgacagcggcaattttatcagagttgattatcacaagcgttcaagctatttgacgcttgttgatccgctgtttttgctttcctctcccattgaatatatgaaaagcgggatcggtgatacgctggcgaaatggtatgaggccgaggcggtcatcagaaatacggaggaagcgccgcctctgatggcgcaggcggggctgagacaggcggaatatatccgtaatctgttattgcgttacagtgaagccgccgtcgtaagcatggagaaaggcgagctgtccatgccgttcatccatacggcggaaacgatcattatgcttgcgggaacggtcggcgggtatggcggccgtttgtgcaggatggcaggggcgcatgcggtccacaacggcctcagttttcttcaggagacacatcaggtgctgcacggccagaaggttgcttacggcatattggtgcagctcgcgcttgagaatcggagacatgagattgaagagctgcttccgttttaccgccggctcggtttccccgtcagtctctgtgctctcggcatccttgacaaccatgaggaagcaaagcgccgcatcgcttctcacgcctgccgggcggaagaatcgttatgcttaatggggcaatattgcgggaaggacgtgtcagcggcgattgaatcgctcgaatcagcacaaaagacaggatagagcttgtaatctgtcttgtctttattttttgaatatttccgttataatgagtggggtatagaaagggaggggccaaaggacatgtatcaggcgaagaagatgttgttattaggatcaggcgagctggggaaagaagtcgtcattgaagcgcagcggctcggggttgtcactgtagccgttgacagctatgagcatgctcccgccatgcaggccgcacacaaaagctatgtgattgatatgcttgataaagcgcaggtcagagaagtcattgagaaagaaaaaccggacttaatcgtgccggaagtggaagccattgcgacggatgagctgctgaagctcgaggaagaagggtttcacgtcattccgaatgcgcgtgcggcaaagctgacgatggaccgtgaaggcatcagacggcttgcagcagagacgcttcatcttccgactgccggctatgaattcgcgaatacatacgaagaatttaaagaagcggcggaaacaatcggctttccgtgcgtggtaaagccgctgatgagctcttccggaaaagggcaaagcgtgtgccgctcggcttccgggctgaaaagctgctgggacatggcaatggaaggcggccgggtgaaaaacggccgggtcatcgttgaggaattcattccgtttgaatcagaaatcactcttctgacagtgcgcgcggcgaacggtacgtccttttgcgcgccgatcggacatgaacaaaaagacggtgactatattgaatcatggcagcctcatcatatgacggaacagcagattgaagaggcgaaacacattgcgaaaagcataacggatgagctcggcggatacggtttgttcggggtggagcttttccttactgaagataaagtatatttcagcgaggtgtctccccgtccgcatgatacggggctcgtaacgcttgtgacgcaaaatttgtcagagtttgcgctgcatgtccgcgcggtcttgggattcccgattccggaaatcattcagctgtcgccgggggcaagccgtccgctgaaggcgcccaaagagcttgctgattatgcggttgaaggtttggagaaagctttggcggtaaaaagcactcaggtccgcgtattcggtaaacccgtcacgaaagtcggacgccgtatggcggttgcgctttctgcagccgagaccgttgaagaggccagagaaagagcggccgaagcactcagtcatttatcaattacataaaatgatcttaaaaggcgtttttaccgtaatggtaaggcgccttttttgtttggacagactatatactggaaaacggggttgtgagataatgtatgaggccgttttgtgccggttttttaattcttgaaactttttatgtccgcaatcgttatatgtaatgttctcatttcacggagaaggaaataacaatacatcatacggcttttcattcatcaagaacggacaatccggatcgcagcatggaatatttaagcagggtaatccggaatagaggaaaccatgattgcttaccttaatatgaacgacgaaaaaacaaaaatcaccagattagattgttcaaataacaccaaatgctgtataataaaagaatttgaatgatagcattgaaaggatttcattttatgtttccgtaaaatggagtctttatgcatacgcagtccgatttgatatggttttaattggaggtttgtgtaaactgtgaattatatacctagtatgattacaattggaaattttatttgcgggctcttatcgattcattcccttttgtatcataatatacactctgcggtgatctttattttcaccgggatgtttcttgatttctttgacggtttggccgcccgtaagctgaacgcggtatcggagatgggaagggagcttgactcttttgctgatctcgtgacgttcggcgtagcgccgtccatgctcgcttacagtgtttcactatatacgcttccgttcatcggaattttaatcgcgctttcctacagcatctgcgggatgatccgtctttccagatttaatattgaacaaagcaagctgccgacgtttatcgggatgccgattccgtttgcgggtatgtgtcttgtcattttgagctttatcaataacgcttttcttctgggggcgggaacgatcgcgctcggttatttaatggtcagcaacattaaatttccgcactttaaaaaacaggcgcctgaaaacctggagagcagaagatggaattagttcagcaattaatatccgattacggatatatcgcgatttttcttatgctgacactcggtattatcggattgcctattccggatgaagtcatgatgacgcttgtgggctacttcgctcatttaaacgtgctgaattacgggctctccattctgatcagctttatcggagcgctccttgggatgattatcagctacttcatcggcagaaaagccggccggccgtttattaataagttcgggaaatgggtcggcctgaaggaaaagaggatggagaaagtagacaggtggatgaagaagtacgggccgtacaccattattttaggttatttcatccccggcatcagacacgtgacctgctacttttccggaatcggcagaatggaattcaaaacctacttatgcttcgccgccatcggagcgtttttatggtgttttatttttattactataggaaaattcataggagtaatcaatgtttaatactgccgctaaagttctttaccgttcattgattgaactgactaataatcgattgacgtcttatctcattaaaaacttctgtgaatcgaaactgagcaagccgatgattccgctgttttccaaacactatcgcattaactggaatgaaacggaacgcacggcttctgactttgattcactggcgtcatttttcattcgtgatattaatttgaatctccgccccgtggcaaaagagaagaacgccatcgtcagcccggtggacggcgtcgttcagacggtgggcatgattaatcccaatcaaactttcatggtaaaagggaaggattattcgttcgccgaactgacggggtttaaaagcgccgatcacaagtataacggcgggtgttttgccgtgctttacctgagcccgagacattaccaccgcttccattctcccgtcagctgcacgtataaaaagctggccgagctggggaaacgctcctatcccgttaatacgatggggttaaagtacgggaaagatgtgctctcaaaaaattaccgttatgtgtacgagctgacccgtgctgatcagcagatgctcatgattccggtaggtgcgatgaatattaactcgatcgttcagacaaacaccggaaaccggcttgagacgggggaagagctgggctatttttcatttggatcgaccgttattttagtattcgagaaaggtatgtttaccccttcggataacctgactgaaggccgtgaattacaggtcggtcagatcatcggttatgcggagtcacaggaggaggcgtccgctttataaaagctgctcctcttttttatatggtgtaaggaagtggactttatggaagaaaaggatttgggaaaactgatcgaacagtaccaggatacaggcgatcagcaaattcttgaagcggtgcgggatgcatgccggcctgtcgttgaggcgctcatctcagaactggctgaagacagcgcggatcttctgcgggcaaaaggccgtgaccgttttccgtttattatcggcaagtatcagaccgcggccggcctttcgcttgagacctttttgcgcaatacgtatcggttttattttcagcaggttttaaaaggcgaagcgtgactggaagaaagagtacggacggaaatgttcatctttcgcccgttttcctgtatgatatagtatagtgtgcgtgatcattaatataattgaacagggtgtataaatcatggaaaaacaatatagagttttactttattataaatatgtaaagattgatgagcctgaagagttcacggctcagcatttgaagttttgtaaggagctcggtctgttaggccgtattttgatttctgaggaaggcattaacggcacggtgtccggaacggttgaacagacggaacaatacatgaatgcgctgaaagctgatccgcgttttgccgacatgccgattaaaattgacgaggctgacggccatgcattccgcaaaatgtttgtgcgccataaaaaagagctggtgacgcttcgtctcgaagatgatgttgatccgaatgtcacgacgggcaagcatttgaaaccgaaagacttttatgagcaaatgcaggatcctgacacgatcgtgatcgacgccagaaacgactatgagtatgacctcggtcatttccgcggagcggtcagacctgatattgaggcgttccgtgagctgccggactggattgaagaacacaaagacatgcttgaaggcaaaaaaatcctcacgtactgcacaggcggcgtacgctgtgagaaattttccggctggctgctgaagcagggatttgaagacgtgtcccagcttgacggcggtatcgtcacttacggtaaagatcctgaagtgcaagggcagctgtgggacggacagtgctatgtgtttgacgaaagaatcagcgtaccggtcaaccgcgtagagcacgttatcatcggaaaagattatttcacgggcgagccgtgcgagcgttatgtgaactgcgcaaatccggcatgtaataaaaaaatgatctgcacacctgagaatgaatacaaatacatgcgaagctgcagtcacgaatgccgtacgaacgaacgaaacatgtatgtgaaagagcacgaaatgactcaggaagaaatcaatgaacgccttgctttgattgaaaaagaggatcatgcggcgattgattaatagaaaagaccaccaatgaggtggtcttttttgtgtttacatactttctgtccgggcggtctggtctgccgtgacgggtcctttatatttgaaggctttttcccatttggatacgacgatgcaggcgaccgcatggccgggcacgttgacaccggttcgcgccatgtccatgacgcggtcgacaccggcaatgatggcgacgccttccgcagggagaccgacggcattcgctgtcgccagaagcacgacgagtgagcctgacgggacggcggcaatgcctttgcttgtcatgacgagcacaagcatcatcagaagctgctgagaaagcggcatctccacatgaaacgcctgcgccaggaaaatacaggacaccgataaatagaggcttgaaccgtcacagttaagcgataaacctgacggaaccacaaaggagacgacccgcttcggacagccgtatttctccatccgatccatcagctgaggcagaatggtttctgtgcttgtcgtggagaaagcgatcaaaaacagatcccaaatcattttcagcacttcaaagtacttgattttaaagataagccccacgatcggaaacagaacgaaaaggatcaggaacagcccgagaaacacagtgccgatcagcttcagcatcgggagcagaagcacgattccgaattgcccgacggaggcggccatcagggcgagaacgccgatcggagcggtgaccatcaccatctgcgtcagcttgaacataatatttgccgtggattcgaagaaactcatgacaggtgcggaggctttgccgatgccggctgcggcaacaccgaataggatcgcgaaaaaaatgacggcgagaagatcatttttcgccataacgtcaatgatgttaacggggataatatcaagaagcatttgtttcagatcgactactttttccgtatagccggaaagctcgtgaatgtcttttttagcaagatgagagaggttaagtccgactcccggcttcagcacgttcgccaataacagaccgagcgccagaacgagcgtcgtaatcacttcaaaccaaataatcgttttgatgccgagactgcccatttttttcatactgccgctgccggcggctccgataacaatggtcgaaaacacgatcggcacgacaatcattttaatcaggcggataaatccgtctcctacaggccgcagcgccatcccgaaatccgggaagaaatggccgatcaatgctccgatggctaaagcaatcaaaatctggaatgcgataaattttttcaagcgaatcccccttttacttgcgcatttcttacgtaattcgtgaagcaggcggcaaccaccttcctgtccgccataaatttgtcacattattgactgtgcgaaaggaaggattgctttacattatgtaagcgcaatcattgaatatgacagaaagtcctcattgaaaaaaatgaaggagcataagaataaagaaagatttccgctgaaaatattaaaaattttgataattatcctcttataagtggtatatttgatatgatatggtcaactgcattctcatatatctgtgcatacaagattcgggacagaaaaaacatgcagcccagagaagactgaaaatttaaacaattagaagaaaggtgtgcttttgttgaatcaactgattgaaagacgtaaggtcacagctagaaaagaaaaaccggattccgcttcattgggatttggcaagtacttcacagattacatgtttgtcatggattacgaagaggggagagggtggcatgatccgagaatcacaccttatgaaccggtccatctggatccttccgcatcggttttccattacgggcaggccgtatttgaagggctgaaggcttacaggtcagaagacggacgggtgttgatgttccgtcctgaccaaaatataaaacggctgaataaatcgttacggcggatgagcatgccacctcttgacgagaagctggcgctggaagcattgatacaattggtggagctggagcaggaatggataccgatagaaaaaggaacctctttatatatccgtccgtttgtgattgcgactgagccttctttaggcgtccggccttcaaagcgttacaagttcatggttgttttgacgccggtcggttcgtattacggcgatcagctgaaaccgatccgtatttatgtggaggatgagtatgtgcgcgccgtcaccggcggagtgggcgacgtcaaaacgtccggaaattatgcggccagcttacaggctcagcggaaagccgaagaactggggtatgatcaggtgctttggctcgacggagtggaaaagaaatatgccgaagaggtaggcagtatgaatatctttttcatcataaacggagaggccgtaacgccggcgttaaacggaagcattctcgggggcatcacacgcgcatctgtgatagagctgttaaaaagctggggcatccgtgtcagggaagaacaggtcgccattgatgacatctatgaggctgcaatgagaggcgaggtgtcggaggtattcggtacgggaaccgcggccgtcatctcgccggtcggcgcgctgcacattcacggagaaacgattgagctgaataacggtttgatcggtgaagtgtcagaaaagctctatgaaacgattgccggcatccaagtcgggaaggtgcgggattcgttcagatgggtcgttgaagtataaatgaaaaaagaacccttgcgccgcagggttctttttttggttattgggattttacggcttgcacgcgggctctgcttttccggtttttcaagtaataagcggtgtagcaaacggccataaatacaattccgcaataaagggcgatggcctggttcggatcaaaagcgatgccgatacaggaggcgaggcataggagaaaggccgctatcggtacggccggatatcccggcgtcctgtatttcaagtctgaaagctggtgcccttctttaagaaatcgtcttctgaacaaaaattgtgatgcggcgatgctcatccacacagccactaccgcaaatcctgagacggagacgagaacaagatagactgtatccgctgcaaatacgcttgacaacaacgacagaatgccgccgatcatactgaagatcagagcgttaaaaggaatgcctttagaggtcagcctggcaaaggcgggatgaagctccccttctttagacagggaccagagcatacgtgatgacgcgtacagccctgaattggccgcggacagaagcgccgttaaaatgacgaaattcatcagatcggccgcataaggcacgccgactctgtcaaataccgtgacaaacgggctttcaatcacaccggcttccttgatggagatcatccctgacagcacaaaaatcgttccgataaagaaaagcgccagccgccagactgtggtcttaatggcgcgcggaacggttttttccggatcggcgctttccccggcggcgattccgatcaattccgtccctgaaaaagcgaagtttactgaaagcatcgtcatcagtatcgggaaaaagccatttggaaaaaggctgccgccatccgtaaagttcgacagcataggtgcggcctcaccgcttttcatcgggacgaggccgaacatcgccgctccgcccaataaaataaacagtaagatggctaagactttaatgcttgagaaccaaaactccgattcagcaaaaaatttcacggagaaggcgtttaataaaaagatgaaaagagcgaataccgcactccacatccaaactgaagtatgcgggaaccagcgctgcatgaagagcccggccgccgtgaattcagagcccagcgccaccgcccacgtcagccagtacagccatgcgaccgtaaagcccgtcgcgggcccgatataggtcttcgcataggtgtggaatgcgcccgtcaccggcatggccactgacagttcaccgaggcaaagcatgacaagatagacgatgcccgcgcccaaaaggtaagcgaaaatggtgcccgccggacccgcctgatgaatggtatacccagagcttaaaaacagccccgttccgatcacacctccgagtgatagcataaagaggtgtctgcttttcatacttctctgaaaattcgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaggtcttggcccaatcggcaatggcttggatgtccgcgggtttcgtccggcagcagcctccgatcaggctcacgccgttttcgtaccagctttgcgcgctttttccgaaatggttttcgcacgctgcgcctttccaggtttttgtcaccgggtcatattgttcgccggagttcggataggcgataatcggtttggatgctgcccgtttgatttcttctatcagcggcggaatatattcgatcggtgtgcagttgatgccgatcgctgcgatttggctgcaggagtcaagcagggccgcgcattcggaaataggcgtgccttcgctgatatgccgcccgtctttggcgctgaagctgatccatgcgtaagtgccggggaattcctccagcagccttgtgatcgcttttgcttctgacaggcacggaatggtctcacaggccaaaagatcggcgccggattctatgagggctttcatccgggggcggtgaaagctgatcagctcatcgtccgtcagtccgtaatgcccgcgatattcagagccgtcagcgaggctcgcgccgtaaggtccgatagaagcggcgaccaaaggtttgggccggtgtaaacggttttcttcatgcgcccaaaattcatcgcgtgcttgtgcggcaagttcaacagatgtctgaatgagacgtatcgcatcggtttccgggatgccgcgcgctgcaaatccttcaattgtcgattgataactggcggtgatcgcgcaatcagcgccggcggcaaaatattctgcatgcacctgtttgatcagttcgggtctctccaaaagaattttggccgaccacagatcgtcatgtaaatcacagcccatccgctcaagctcggttgccatcgcgccgtctatgatcataaccgggtattcatttaatatttgtgtaatgggattcataggccttcctttctgactttactgaaaatatataaaaagggtaatggacgctattctctttgtcaatgaaccggcggaaaaaaggtgttcaggacgctgcccgaacaccttttgtttaggaaatgtttttgcctttcgcgcttttcgcgatatctgaatactcccagcattcgatcccgtcatcatcagggagcacatctctgtaaaagacggggtcctttccggctttcttttgccgggcataatcgctcaaagcggcaaacgcttttttcgacagaaggaaaatcgcgattaagttcacgaccaccattaaacccatgaacaagtcagccatatcccacacaagctggactttggaaatacagccgaacagtaccattccgagcacgcagatgcggtaaatgaacagccactttttgttctggcttaaaaatccgatattggtttctccgtaataatagttgcccatcagagcgctaaagccgaacaaaagcattaagacggcaaggaaacctgacgcccacgcgccgacatggtcgctcaaggcggcctgagaaagcgcgatgccgctcagtcccggctggtgataagcgtctgaaaataaaatgataagcgccgtgcttgtacaaatgacgagcgtatccgtcaggacgccgaatgcctgaatgagcccctgtttcaccgggtggctcgtcgtagctgtcgccgccgcgttcggagcgcttcccatacccgcttcatttgagaaaatcccgcgtcttacaccttgcatcaaggccgcacctaaagcgccgcccgctgcctgatcaatgccgaacgcattttttacgattagcgacagaacgccgggcaactgggtgatattcgtcagaatgacaaagaaggcgacaccgatatataaaacggccaagacgactacgatgtattccgccattttcgcaattcgtttgacgccgccgaagattacgccgccgaaaaccaagattaaaataatgcccaatgtaagccggctggtgccgaacgcgttttgaaaggcgacgctgatcgtattggattgaacggaattaaaaacaaccccgaatgacagtgtgattaatacggcgaacagcgcgcccatccagcgtttcttcaggcctttttccatgtaataggccgggccgccgcggaatccgttttgatcttttactttataaatttgggccagcgtgctttcaacaaagcttgaagccgaaccgatgactgcgataatccacatccagaaaatagcgcccggaccgccgagtgcgatcgcaatggcgattccggtaatattcccggttccgacacgcgccgccatactgatgcaaaatgcctgaaacggggaaatgctgttttttgtccgggcggccgcgccttccttcaaaacccggatcatttccttcagcatgcggacttgcagaccctttgatctgaacgtaaaaaacagtcccagagaaagaagcagtacgattaacagttttgaccataaaaaatcatttgccgagccgattacattttcaaggaattcctgcatccaatcacctcttggttcgtttgattaaaaaatactgagctcccactcctgtgcaatatgtttcagcagcatgccgccggtcaggctgttgccgtattcatcaatggccggaccgtaaatgccgatgccgcatccgttatgaaaaggctgctctcttctggcgcttgggggaaccaatgccatgatgccgccggataccccgcttttggccgggacgccgacgaaagccgcatatttgcctgacgcattgtacatcccgcacgtcagcatcagggctttggcgagtttcgcgacatctttcggaatgacctgttcccgtcggatcggatggtagccgtcatgggcaagtatcaatccgattaaagcgatgtcctcggttgtaccctccatggcgcactgctttaaatacacttcaagcgtttcttccacatccgcctcgagaaagttcgtttcttttaaatagtaggcgagcgctctgttccgatgcgcggtctgccattcagaacggaagacctcctcgtgaatgtgaggccgttttcctattaatttttcaaaaacggaaaagagatattctaatttattatgcgccgtttcacccggaagcagcgaggcgacggtaatggcgccggcattgatcatcggattgaagggcttcccgggtttatggatttcaagccggatgatagaattaaacgcatcacccgtcggctccacgtccacacgatcgagcacataaggaatgcctctggacatgcaggcggcaataaagctgatgacttttgagatgctctgcaatgtgaacggcacattccattcaccggcatgaatcattgagccatccggctctaatatgcaaatgcccagctgagagtcgttgatttctccgagggcgggtatataatttgcgctttttccattgacggaaaacggtcggtaatgctcgacccaatcttgtaaaagtgaagccagttcctctttttcaaggcgctctctgaccatatctttcataacattcctcctctattgcaagcctgtccgaagcggaaaccggtcttggaaaacgttttcaaaaatagcgtgttccatgttaatgtataatgacatctacagaatcatacaaaatacgacaaaatcattcttaaaataagccgatagatttataaatcagccggagtgtcccgccattcgggtctaaagaaatttgcggactgtatcggtcttgttcaaaatagacagaagaaggaagtgattatgatcaggctcgactatttactgaaaaaagacggctatcttttcgctcttatgctgatcaccgtgccgctggcgggggaactgaaattttaccccctgaatgaggtatatcggatcagcttcggcgccccggcttttttcttttttcttctgctgcttcggcatgtgccggcggtattgtcagggctgttgacaggtgcagccgttgtggcattccggatcggcctggcgtgctggggaggagagcatgccggatttacggcggcttttttcagccaatatcccagtttctttttttactttacatatgcctgtttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatatcgcggttatcgctgtttctcacacatttattgtgctgagttttttcaacgtgatgaagctgcacgaatctcaggtcagggaaaaacaaacgagaaagcagcatgagcacatgctgatgattgtgtctaacttatatgaagaaacgattcatctgaaaaaaacgttaaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcggcctcgttatccgcatcaatgaaaaatacgccgaatctttaggcaaagacattcaattcaaaagcgtgattgaaggagaacaccccgattatcacgtctttaccgtcctgtcgatcttaaataacctgaccgccaatgccgtcgaagccatgggtgacaggggtgagatccgcctcgcgctgcgcagggcggagggggggatggccgaatttgaggcggaagatgacggtcccggcattccggaaaaaatcggagaggtcgtttatgatcccggttttacgtccaaatacgatgaattcggcacaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataatatgcgtttttttatagctgatgatgaccgggcgatccgttccattttaaaacagatgatcgaggacgaggacttaggagaagtcgtcggtgaggcagaggacggaagccagattgaagggcattatctccatttcaaacaagtcgatattttattaattgatctgctgatgccgggccgggacgggattgagacgatccggcatcttcagggggcgtacaacggaaaagcagtgatgatatcgcaggtggaggcaaaggaaatggtgggagaagcttattctctcggcatcgaatactttatccataaaccgatcaacaaaatcgagatcgtcaccgttttgcgaaaagtaaaagagcggattgaactggaaacctcgatcggcgacatccaacattcgttaagccgtcttattcagcggaatgaaccgaaaaaaagcgggccgggggggatgcacgagaaatcaatcaaagaaacaggaaaatttcttttgtcggaattaggcatcgtgggagaaagcggggcgcatgacctcatggccgtccttcactatttatttgaggatgaacaggcggaaagaaacatcccgtctttaaagcagatgtttacaaacgccgccattcggaagctgggacctgcggcggcacaaaccgaggttaacagagaaatcaaagcctcggaacagcggatcagaagagcgatcattcattcgttaaaccatttcgcttcattgggcacaactgatttttcaaaccccaaatttgaatattacgcctcgaaattctttgatttcccagctgtcagcaagagaatgaaagaaatgcaggccaaggaaaccgtgccgctttctccggttaaagtgaatatgaaaaaattcattcacgtcttttttttggaggcgaaagatttacgcgaaggatcaaaatttgtcagcggaggcagccggtaagctgataaatagggtttacgtatataaggtttttgtgtaaaataatgttaactaagaaggaacggagggatcctgatggctgatcaaattccggttttcgcactaatgaaatagtgtcaaagtctctgccttgagcgcggaggaaaccgggattgtctgcctgaataaggaacctgacagtaatagtgagggggcggcgattatgccgccctctttttggcgtcttcacacatctctttcttctccgcctaaaggcgaagctctgtgtcagtcaataagggaaatggggaaacaagatgacaaaaaaacaaagggaaatagaatccgttttgaacatcgcaaaggaaaatggcttacggttaaaatatgaaggggcggacataaatgaaacgggtatggacttccaagtcgtatttgctgaagatgacagcggcgtgacatgggtgctccgaaagccgcgccgtcccgatgttatcgaaagagcggctgcagaaagcgatgttctcgcgtttctccgcagccatgccgctgtatcagtccccgattggcggattcatacaccggaactgatcgcttatccgaaactggacggaataccggctgccgcaattgatctggataagaaacagtatgtctggaatatggaacacgagccgccttcagacggttttgtcggctcgcttgccgcagcattagccgggctgcacggggcagacccggatgcggcctccagatccggaattgaaatcataaaaccggatgacgtcaggcaaagggcggcggaatcaatggatcatataaaaaaagaaatcggggtttcagaacagctttggaaaagatggcaaacgtggataaatgacagctcgtactggcctgatttttctgcgctgatccatggcgacttgcatcctccgcatattttgatcggcgaaaatcagcgtgtgacgggtctcctcgattggacggaggcaaaggttgccgatccggccaaggattttgtcctttatcaagtgatattaggagaaaaagaaacaaaacggctgatgaagagctacgaagctgagggcgggcgcgtctggccgaaaatgcaggagcatgtgtcagaatggcaggccgcttaccctgtggaaacggcgaagttcgcgcttcagacggggcaagaggagcatatgcaaatggcgcgggacatgctcggactgtccgatccgaaaggttattgacttccgccggatgacagcgtatgatacattttaaaatcatagaacggatgaacaatgctgaggaagagtaagtacgcatcagcgcgcggggttcagagagtcggtggccgctgtgaaccgatccccgtccggtgccgaatgggcttctgaattgctgcgctgaaataacagtaggcggtgccgggattctttccccgttatcaagataggagtattgaaaccctgagtttctgtactttttgagagaatggctcttcagccgttaataaaggcggcgccgcgaaaacctcgtcctttgatggacggggtttttttgcgttgttaaggaggtgatggccatggaaagtgactggagacggacagacaatcaaaaaaggagggatattcatggtgatcgcaaccgacgatcttgagctcacatgtccgcattgtgaaggaaccggcgaggagaaagaagggacgccctgtccgaagtgcagcgcgaagggcgtcatattgaccgctcaaggaaacacgctgctgcattttatcagaaagcatatggatcagtgaaatcaaacgaatatgtaaagaaacagcacaaaacaaaaaagcttgtagaaaaaacatcgttttctctacaagctgctttttcattcttcaaaataaggattcacatggatgagcacttcttcaacatctgaaaagtgtcttttgatttcatttcggatttcccgggctatatcgtgtccctgcttaatcgtcaaatcatgatccaaagataaccggacatcaagcaatttatagtggccgtgttctcttgctcggattttatcgagccgtttgacttgagggcaatccaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatttttccccttgtttgatcgaataacgatataagatctgcttagccacgtaggatatcagagccgcaaacaatgcgctgtattgcgggatgcttggaccttcaacaaaggacgaaatcgcttctatcagaatatacacggaaacgagcactaatatgattcctacaatcgcttcgctgatgacctcagctttgccatgcccgaaaggatggtcttgatcgggcggcttattagaaatgccgatgacggccaggacagcaattgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgtcattttttcctcctataaaactgcacaaaaaaataggagcgctcttgattcgctctccgtatcctttcttgtgtaatcactttgcttatcatatcaattcagtttcgagtgggtctatagcaaggttgtttcctgtttactaataaataaggtgacagaaaaaaagttggagcagggctaaatagtacataaacaaaattgcgctgaatttaaaaatgaactgttgacatttgagtatttatcttttattattatcctgaattcaagatattttaattcgagacaatttaattagagtgcaggataagaacctgccgatcgttttgttttttgatcatacattatttgattttttataccataatatctcgaattcgagataaaggggagtgcgagagaaatggctgaatttgtacagctggtgaatgaaagaagatctgcaagcaactttcttccagaacatccaatcacaagagatgagctcaacgaaatgtttgaattggttgcgttggctccatcagcttttaatttgcagcatacaaaatatgtgacggttcttgacccggaggtaaaagaaaagctgaagcaggccgcaaacggacaatataaagtgttcagctcatcagcggttcttttggttttaggggataagcaggcatatcagcaagcggctgacatctatgaaggattgaaggtgctgggggtattaaataaacaagagtatgatcacatggttcaaaacaccgtttcgttttatgaaaacaggggagaactgtttaagagaaatgaggcgataagaaatgcttcactttctgcgatgatgtttatgctgagtgctaaggaaaaaggctgggacacctgtccgatgataggatttgatcctgaagccgtgaaacagattttgaatatagatgatcaatttgaggtcgtcatgatgattacaatcgggaaagaaaaaatagaaagcagaaggccgcgcggctaccgaaagcctgtgaatgagtttgtggagtatatttaaatatttataaaggagcgcataaaaatggctaaaaaaacgatgggaatccatcatattacagcaattgtcggccaccctcaagagaatgctgatttctacgctggagtgctggggctgcgattggtcaagcaaacggtcaattttgatgatccgggtacgtatcacctttattttggggatgaaggcgggaagccgggaacaatcatcacattctttccgtgggcggacgcccgtcaaggcatcattggagacggacaggttggcgtgacatcttacgtcgtgccgagaggtgctatggcgttttgggaaaagagacttgaaaagttcaacgtgccatacacaaaaatcgagcgttttggggaacaatatatagaatttgatgacccgcatggcctgcatttagaaatcgtggaaagagaagcaggggaggccgatacgtggactttcggagatgtaaccccggatgttgccattaaaggctttggcggtgcaaccctgttatcagcacagcctgaaaaaacaggtgaattgctagaaaacatcatggggcttgagcgagtcggcaaggaaggagacttcgttcgttatcgttctgccggtgatatcgggaatgtgattgatcttaaattaacgccgatcggccgcggacaaatgggtgtcggcacagtgcatcacatcgcttggcgggctcaggatgacgaagatcaattagattggcaaagattcattgctgcgcacggatatggtgtgactcctgttcaggatagaaactattttaatgcggtttacttcagagaacatggggaaatcttatttgagatcgcaactgatccgccgggctttgcccatgatgagtcacaagaaacaatgggcggaaaattgatgctccctgagcagtatgaaccgcaccgggcacaaattgaacaagggctgctgccgtttgaagtaagagaattagattgatttgacacataaaaaataaagaaacatatagtcaattgatgattgctggatggtaccgtccagcaaagaatcagatgaaatcaaagatgaggagagataaaaatggaagatgcaggactattacttattcgaatcatgattggtgtggtgtttctgttttatggatcacaaaaattattcggctggtttggcggatacgggattaaaggaaccggacaatggtttgagtcaattggagttaaaccaggcaatgccgcggccgctttatcaggtctcggggaactcgcaagcggaattttatttattttaggtgtattcctcccgcttggagctgctatcataacgatcattatgttaggtgccattgtaaaagttcatggagcgaaagggtttgcgaacggtgccggcggttttgaatataacttggtgctgattgcagtctccatcggagttgcactcatcggttcaggagcttacgctttgcatttttaatataagtatctaagaacagttactgaaaagcggtaactgttcttttatttttcaaacacgacgttaaggtgctctgaatcgcaaaaaagcggatatgatcaatataaatgtgtatagtgaatgtacgagtattgatgagcttggtcatgaaagacgagccgatttgaaggagggttttgatgaaagagctgacagacttacattcattagattctatcgagaattttattaagcagcatcaattcagttttatctacatttcaagacctgcctgtacagtatgtcacgctgttctgccgcagctcagaaaagttttggatcagtttccgaatatcaaattggggcataccgacgctgacgaggtagaagaggttgccggcagattttcagtcttcactatccccgtgcttcttttgttcattgatgggactgagtttctgagagaagcccgctttgttcattttgaacagctcgaaaaaaggctgaaaagggtttatcagttatatcaagatgtataaagcgtttatactttacaatgcgggagtgctttttctccacctaaaatagatgaatatgaaaagaaacaggaaaaaacaaaaaagcttgcagaaaaaacatcattttctctacaagctgaaggccgttatccggccttttttacattattcggaccggggttctaaaaaacgggaccctcccaagtcttttctcatcagatagatatggaaaaaatattctccgacggcgatgatgacggcggaaatgagagcggcaaacgccagtcttcctccggaaatgcccatggacagcggcattcccatcagccagacaacaagaaacgcgattccgaaatcagcggacgccgccgtgatattattccatctcggaagcacgtacaggtcgcccgtaaagtaggaaacggctcccagcacaatggtcatcagcagcacgtcaccgaatgtaaagcgaaaacctaagccgagtatcagatacagaataatgatggtcataatgcctttaatggcaagcgctttaatgtgttccatgcgaattcctccttatggaaatcatgttagtatgtttcctcataacgtgaaatataaacccttttttcgtgaacatttgttttctggcttttggctgtcatcactgggccgctgctgaatatgatgaaaggagaaaatacgggaggtgtcatgatggcagtcgtaaaagcgtcgagcgccgatgtcgatctaatggcaaggctgctcagggcggaagcggaaggcgaagggaagcagggaatgcttttggtcggcaatgtgggaatcaatcgggtgcgggcgaattgttctgattttaaaggtctgcgcaccatcaggcagatggtgtttcagccgcacgcgtttgaagcggtgactcacggatacttttaccagagaccgcgtgaatccgagcggaggcttgcccgcaggaacattaacggagaacggttttggccggctaagttcagtctgtggtactttaagccgccgggcaactgcccgcagacttggtatggccagccgtttgtcgccagattcagatcccactgcttctatcagccgacaggtgagacgtgcgaaaacgtgtacaatacattttaatcccgggggcaccgttcttaaaatgaacggtgtttttttaatgttttgtgaagaaaaataggaaaaaagtgcgcttgacggatgacaagccaaaaagaaacagagggggttttcttccggcggggcaaggtttgtcgaaacaatgtgaaaaatgtctcccgccgtccatttttcagccttacaaacccttcacacttcttcatagcggtttaacatttcttttttataataagggcgatcaatgagacgaaaggggaactgacatgacacatgacggccgtttagatgaatggatcaaggaattggagaacaaaagctttcagaaccatacgtttgaccgccgcgcatttatacagggcgccgggaaaatcgccggtctttccctcgggttagcgatcgcgcaatccatcggcgcgtttgaagtgaatgccgctccgaaattttcaaactatccgttcaccctcggcgtagcttccggcgacccgctgtctgacagcgtcattctctggacgcgtcttgcccctgacccgctgaatgggggcggcatgccgaagcaggccgtgccggtaaaatgggaaatcgccgcagatgaacatttccgtcacatcgtcaaacgcggaacggaaatggccaagccgaatctcggacactccgtccatgtcgaggcggacgggctcaagcccaataaagtgtactattaccggtttaaaagcgggcatgagctcagtcccgtcggccggacgaaaacgctgcccgctcccggcgctgacgtatcggccatgacgtttgcatttgcctcatgccagcagtatgaacacggctattatacggcgtataaacatatggcgaaggaaaagcttgatctcgtattccatctcggagattacatttatgaatacggaccgaacgaatatgtgtcaaaaacaggaaatgtcaggacgcacagcagcgccgaagtgtacacactgtcagattaccgcaaccgtcacgcccaataccgctctgatgccaatctgaaagccgcccacgccgcatttccgtgggtcgtgacgtgggacgatcatgaggtggaaaacaattatgccaatgttatccctgaaaaaggccaatccgttgaagcgtttgtgctcaggagggccgcagcttatcaggcttattatgaacacatgccgctcaggcgcatgtcattgccgaacggtcctgatatgcggctgtacaggcaattttcttatggcaatttagcatcgttcaatgtgcttgatacgagacagtacagagatgatcaggccaacggcgacgggaataagccgccttctgatgagtggagagacccgaagcgcacattgatggggacagagcaggagcaatggctcttcgaaaatttagccgcctcaaaagcgaagtggaatgtgctggcgcagcaaatcttttttgcgcaatggaatttcggaacaaccgccaatccgatatacagcatggattcatgggacggctacccggctcagcgggagcgggtcatcaattttataaaaagcaaaaacctgaacaatgtcatcgtgctgacgggtgatgttcatgcaagctgggcgtcaaacctgcataccgattttaatcaaacgaattcaaaaattttcggggccgaattcgtcgggacctccattacatctggaggaaacggggcggataaacgggccgatacggatcagatcttaaaacaaaacccgcatattaagtttttcaacgattaccgcggctatgtccgctgtacggtgactcctgcccaatggagagcggattacagagtggtgccgtacgtgacggagccgggtgctgaggtatccacgcgggcttcattcatttatcagaaagaccagacggggattcggaaggtctctcaagcggcggttgcaggcggtttaaagcagtcaaacgaggtggaagaggatcgtttcttcgcccataacaatgcgcatgaaaagcaaatgagaaagaaacgggccaaaatctcacaataaggaggcgcactcatgttttcaaatatcggcattcccgggttgatcctgattttcgtcatcgctctcatcattttcggaccttcaaaacttccggaaatcggccgtgccgccggccgcacgctgcttgaatttaaaagcgccgcaaaaacattggtctcaaatgaagagccggacaagcagacggctgagaaagacaaaacggcaggctgaatcctgacatgggggcagacgaatccgcttctgcctctttctctataaggaggatgtacgattggataaaaaagaaacccacttgatcgggcatttagaggaagtccggcagcgtctcattaaaatcgttatcgcctttctcgtgttttttatcggcgcctgctggtttgtgcaggatatttatgactggctgatcaaggatttgcatggcaggctggccgttttagggccgagcgagattttatgggtgtatatgatgattgcgggaatatgcgcccttacggcagcgattccggttgcggcctttcagctctggcgttttacggcgccggctttgaccccgttcgaacgccgcgccgctttgctttacattccggggctttcgcttttgtttattatcggaatttccttcgggtattttgtgctgtttccgattgtgctcggatttttaacacaattatccgccggccattttgacatggtatttacggcggacaagtattttacctttatgctgaatcttacattgccgttcggatttttgtttgaaatgcctctggccgtcatgtttctgacacggctcggaatcgtgaatccaacccggctggcaaaggcgcggaagctttcgtattttttgctgatcgtcgtctcggtgctgattacgcctccggattttatgtctgactttctcgtcatgattccgctgctcgtcctctatgaaatcagtgtgacgctgtcccgcatcgtttaccggaagaaatgggccgaggtgtctgccgcttagtgaagctcgcctccgccggtctcaatatcgtcctcatgcgccgcggcggtcaccgcggcgattttgagcgcttttgtcacgagatccaggctgaggctcggcgcagacttctgcaaagtttgctccggaatgtacgggatgtgtataaacccgccgcggatgtgcggatgatggcaggcgatttcatccatcaggccgtaaaagagatgattgcatacaaacgtccccgccgtgtaggatacagccgcgggaatgccttcctttttgatttcctcaacgatccgtttgatcggaaggccggtccaataggccgcgggaccgtcttgagaaatgttttccccgacaggctggtttccttcgttatccggtatgcgcgcctcattcagattgatcgcgacccgttccggcgtgatctgcattctgccgcctgcctgtccgacacagatgataatgtcaggctgatgctttttgatcgcctcgcgcagcacggcaagggacttataaaaaacggtcggcacttgttcagatacgatagaggcggggccctcagcggcaccgtccagccgtttgaccgcttcccatgaaggattgaccgtttccccgccgaaggggtcaaagcctgtcagcaatacttttttctccatataaaaccctccttttctttttaccatactctataatggacatatattcctgccgaagggggaaacatgtcttgaattcgcctctggtgcaataccgatctttatttccggcgctccgcacacatacgatgctcgccagctgctctcaaagcgctcttgccctgccggtttcaaaagcggtcaatgactatcaggaaagcctgcttcagcatggcggaaactgggaagaagccattggacgtacggagcaggcaaggtgtgaatttgcgaaattgatcggcgcccatcctgaagaaatcgccgttttaccttcagtaacggctgctgtctctgccgtcgtttctgctttaacggattgccgaaagaaacaggcggtgtatacggaattggattttccggcgatcgcccacattttgaaggcacagactgagatggagctttcagtcgtgccgtctgaagatggaatgatcccgttagagcggtatgagacgtacatatcggagcagacgcttttcacctgtgtgccccatgtgtcatatacgtcggggtttgtccaggatatgaagcgcattgccgagatatccgcaaagaaggaatcgcttctttttgtcgatgcttatcaatcggcggggcacatcccgattgatgtaaaagaatggggagttgatatgctggccgcgggtgcgagaaagtatatgctcggcataccgggaacggcgtttctttatgtcagaaaggaacttgccgaacggctgaagccgaaagtcaccgggtggttcgggcagcagcgggcgtcgatgctggatttaacccgtttttcttatgcggacggagccaaacgctttgagaccggaaccccggcatttatcagcatatatgcggcacaggcggctttatctctattaaacgatgccggcacagaccgcattcaccaagaagtaaaaaaactcagcgcatttgcgtatgaatacgcttctgaaaaaggactgaacctcacagggccgcagtctgccgatgacagacccggcatgatttccatacgggatgaaaaagcggcggaaacggctgcgctgttgaggcggaaaaacatcgtatgcgcacccagcggacaaatcatccggctggcgcctcatttctataacacggctgacgatctgatctatgcgattgatgaactggctgaagcgcgcggtatataaaaaaacagcagactcacggggagtctgctgttttcttatgaatgattcactttgacccgtttcataaagaaagcgctgatcaagccgataacggcgacaatcatcgcgaagataaaggcatgctggacgcccgcaatcagcgcgtgagagtatgcggaaggatcattcgggtttttcgcggtgctcatataattcttctggccggcagccatgatgctgaccgccaccgcagtgccgattgcgccggccatctgctggagcgtattcataatggctgttccgtccgggtaaaattccggcggcagctgatttaagccgttcgtttgcgccggcatcatgatcatggaaatgccgatcatcaggcatgtatgaagcgcgacaatcagaagcgccgtagaagcgccgttaatgtttgagaaaaacgaaagcacagttgccgtgatgacaaacccgggaatgacaagccacttcggcccgtatttatcaaacagacgccccgtcaccggagacataaagccgtttaaaataccgcccggcagcaggatgagcccggacgtaaacgccgtcagcatcagtccgctttgtaaatacataggcaataggagcattgtcgataagataaccatcatacagataaacacaatcacgacaccgagaacaaacatcggatagcggaaagcgcgcagattcatcatcggctgcttcattgtcagctgcctgatggaaaataagatgagcgcgatcgcgccgacagtgagcgaaccgataaccgtcgggcttgaccagccgtctgatccttcgcccgcattgctgaatccgaatacgatgccgccgaacccgatcgtagacagaataatggaaagcacgtcaattttcggttttgtaatgtctgacacgttctgcatgtaggcgatgccgaataaaagagccaacacaagaaacggcagggaaatccagaaaatccaatgccagttcaaatgctctagcacaagccctgaaaatgtcggaccgatcgcaggagcgaacataatgacaagcccgatcgtccccatcgccgctccgcgcttatgcggcgggaagatgacgaggattgtattaaacatcagcggcagcagcagcccggttcctaaagcctgcacgattcttgccgccaaaagaaacggaaagctcggcgcaagcgctgcaatcagcgtgccgataatggaaaaagcgagtgaaacgatgaacagctgtctcgtcgtaaaccattgcaaaagcagacccgataccggcacaagaataccgagaacgagcagatagcccgtcgtcagccactggacggtcgcaggagtgatatgtagctccttcatcagatcagtcagggcgatattcagcgccgtttcactgaacatgccgataaaccctgccgtcagcaaagaaatcatgatcggcatgactttatattgtttggaaggctgagcgttttccaaaatcattctcctctctttctatacgtaaatgtctctcgtattttatgtcttcagcaggttggggatttgtttagaaatatggaggatcggcattttgtcttttttggctaaggacacaatgatgccgccttctatcatggcatttagaacagtgctgatttccgccgctttctcatcagaaaaaccggctgatcttaatttgcccgcgaacagattctcccattcctgataagcgttttgacaggcctgccggagcttttcgctctttaaagcagtctcggcagccagtaaaccgacaggaaacccttcaaagttctccggacatgtgaattgccgtgataagtcctgtaaaaacgcttgaatgctttccgccggatcaggatgggcatcaaggctttcttttattttcatacggatataatggctcatttcattgacagcctcaatggcgagctgctctttgccgtccggaaaatgatagtaaagagaacccttcggcgcaccgctttctttaataatctgattcagtcccgtgccgtaatacccctgaagctgaaacagcctggttgctgcggcgaggattttttcacgagaatctccatagctcataatgttcccaccttactgatttgtgacaaatttaaaatatagtgactggtctattatcttgatttcgcatggcggtgtcaaggttttttaacggttattttcttcggaaggttgcctgacaagcgcgttgaccggtgagaggaaaatcttcataaataaagaaaaggagagaaaagaatgaaaaaacaattcatgcccttcattacatttatcacggctttgctcttcatcgcggccggctgctcccaatctcctcaaacgaaagaaacaccgccccagatggcagccgcagcctctgcgaaaaaagacggacttccgaatattaaaattcttgccaccggcggcacaattgcaggcgctgctccttcaaagacgtccgctacggagtacaggccgggggcaatcggagttgatgccctgattcaggccgttccggagataaaagaggccgcgcatgtgagcggagaacaggttgtgaatatcggcagccagaatatgaataacgagacactgctgaaacttgcaaaacgggtaaacaagctgctcaagtctgatgatacagacggcattgtcattacacatggaacagacacacttgaggaaaccgcctactttctcaatctgacggtcaagagtgacaaacccgttgttgtcgccgggtcaatgcggccgtccacggcgatcggagcggacgggccatccaacttatataacgcggtaaaaacagcggctgcgcctgaggcgaaaggcaaggggacgcttgtcgtattaaatgacagaatcgcttcggcgcgttatgtgacaaaaaccaatacaaccgcgaccgacactttcaaatcggaagaaatgggttatatcggaacaattgctgatgacgtctattttaataacatcatcacccgaaagcatacgaaggatacagatttcaagatagataaacttgataaactgccgcaggtcgatattatatacggctatcaaaatgacggaagctatctctttgaagccgccgcaaaatcaggggcgcaaggcattatttttgcaggcccgggaaacggctcaatgtctgatgcggcgctaaaaggcgctgtaaagtcggtcaaaagcgggctggcggtcgtccgctccacaaggacgggaaacggggcggtaacaccgaatcgagagtatgaaaaagaccatttgacagcttcaaactctctcaaccctcaaaaagcgcggattcttctcatgctcgcgctgacaaaaacgcatgatcccaagcggattcaaacctatttcaatgagtactaggagtagagaaccgggtgttctctcctttgtcggtatgccgtattaaagcataagcgtgctttcgggaaaggggcgtctttctcatttttccgctcttttttaattgttgaaaacagtaaaaaatacactattttttccttttcttctctaatagaatgaaaactgcaaaaatattacatagcaggaggaaagttcatgaaacatataaaaagcaaaatcctagtcatccttacagtttgtatgctgtccgtcatttccgtatttgccttccagccgaccgtatcgaaagcctcctcagggcataaccctgttgtcatggttcacggaatcggcggggcgtcttttaactttgcgggaatcaaaacatacttggcatcccaaggctggtcaagaaaagagatgtacgctattgatttcttagacaaaaccggaaacaacagacacaatgcgccgagactgtccaattacgtgaaaaaagtgctcagcgaaacaggtgcgaaaaaagtcgatatcgtcgcgcacagcatgggcggcgccaacacgctctattacattaaaaatcttgacggcggagacaaaatcgccaacgtcgtgacactcggcggagcgaacggccttgtgaccaaccgggcgcttccggggactgatccgaaccaaaagattttatatacatcgatttacagctcagcggacttgatcgttctgaacccgctgtcacgactgatcggcgggaaaaacgtgcagattcacggtgtcggacacatcggacttttgatgaacagccaagtaaacgggctgattaaagaaggtctgaacggcggcggacaaaatacaaattaacagtttcaaagccccggagaatgagaatatcccggggtctttttttcttccatattcttttttcgccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagcaaagaagctgccattccggcagacatcgcggcaaaagaagcgaaacagattcaggaaagcttaatggagtacgcctttacagcacatagagacggcatatcatcatttattaaccagcatgagttcattacggagctggacagacagactaaagacatcggagtcttcaacctcggcatctggggaattttcttccgtccgctggcaggcggcaagacgatttttgaagaatatcttcagaaaaaagccggcggcatcaaccgtccgaaaacacgggaaatcgttgaatcatggaaaagcatgacaccagcggttatggtgcttgaagatgtgaaagaaggaatgattcactttgaagatgtgatgacgaaaaaacaattcaaagtggaaatggacgtcagccagcaggatcttccgccggcgggaagcctgattctcggctatccgatccacgaagcggaaaaagcggagttctttatgcagtttacgatcttccctgtgaagcggaccgaagctctaatcagcaaagtgaaaaaggcggctgccccggcccttgcggaaggaaaatcgcctgagcgctttatgcaggaggacttcgacactgtgctggccgctcttttaggaacggcggaagagcctgagcaggctgctgaagaaaaacagacggagtgggcgaacgacatggagaaggaaacggcggacgccattgaaaaaggcctgagcggggatgaatacccggctgagctggttccggccgttattgacctgtggaaaacgttctgtgtcaaaaaaacaccgacgatcagaaagccggaagctttcgcggcggcggtcgaatattacgtaaacagtatttctctgaacggcgcgtccgtttctcaggctaagctggcgaagaagtacggcgtcagcgcctcaacgatttccagccgctataaggaaatcgaaggtgctctcacagatgaagccgaacgcttcgccgcagctctgacatcttaagacacagccaaaaaaccttgaagggcacatgcttttcaaggttttttctgcagaaatgctctcggggcaggataattcttaccggttatctaatactaaacagagcgataaaaggaagggagcctgagccatggatgagacacgtacgctgggcaggacggatttacgggtaaagcgtatcggctttggcgctaatgcggtcggaggacataatctatttccgaatcttaatgatgaaacgggaaaagaactcatccgcacagcgttggacggcggcgtcaattttattgatacggcgtttatatacggtttggggcgttccgaagagttaatcggtgaagttgtcgcagagcgcggcgtgcgggacagcctcgtgattgcgtcaaaaggcgcgcacaaagaggtcaacggacaaatcgagctggacaacagccgtgaatttctccgtaatgaggcggaaaacagcctgaagcggctgaaaacagacgtgattgatttgtattacgtccacttccctgacggcaaaacaccgctctccgaagtggcgggcacgctaaaagaactgaaggacgaagggaaaatcagagcaatcggcgcgtccaatctcagcttcgggcaattgcaggagtttaacgccgacggttatttagaggtttttcaatcagaatattcactgattcagcgtgaggcggagcatgatctgctgccttattgtgaaaagaacggtatttcttttattccttattttccgcttgcttccggcttgctgacgggaaagtttacaaaagacacagtctttgaggacagccgaaaaaacaggccgccgtttcagggagaagcttttcaccaaaacctggagcgagtggataagcttcgggccgttgcggaagaaaaaggggcgcagacagcgcatatcgcactcgcgtggcttctgtcgcagccggcggtggatgcgatcattcccggagccaaacgccccggccagctgaaacacaatctgggcgcgcttgatgtgcaattgaccgaggatgaggttcaatatatcagtgacatcttcaagtgaaaataaaaaaaggaaatagcctgcgctatttcctttcttgctgtcaggacgtttttaaaaacgcttctgtcaatccttccagatcggcgtctgtatccagataccactggccgcgggcgtttttcttcatctcgatttctcttgttacggaagaagaagccggtttcaggcgcataaactcttccggatagacagaaagcaggtggctgacaatttcgttttcatcagcatcggggtgctttccggcatagtcttgcacgcggtcttgcagctggcccgcgagcggagacatatcaagcggcgtcacttttgcttcaaggacggcttttttgcctgacatggatttggtatgcaccttgagctctgtgttatcccgaagcgctgatgacatggcgtcaataatagcggaaatggcttttgaatccgcctgttcttgtgaaatgcctgcagaagcgataaagctggctttcgccgattcctgatatgcggcggccgtcattttttcatttacaccggtcaggcgggtgaaatctttattgtgcttgccgtacagcatcacatcaatgtatgcggataatgcgtccgccgggtcaggttttgcgtttgaggctgtgcctttgactttcagtttataagataaaggcttcgcgtcttttgcctgcggctgatataccaattcatatgatttgccttcgtcagccgtgaagtacagattgcccgtcactgtcttgcccgcatgaagcgtgccgctctgcatctggtcatccttatcggccgccgctgttttcgcgtcatcctgataaagcgagaagtcgctgcttttgacggtaagcgggtctttgcccgtatttttgacggtgaccgttactttcagcgcggccggatgttcagtatcgtctgaagcggcccatgccgtctcttttattttcactttcgccgtgctgctttcctggccgccgctcgtttcgctgctgcatgcggcggtaaatgccgtgagaagcagtatgaaaaacacggcgctcatttttttgatggacatctggtttaccccctgttgttataatgattaattcaatagtcatgaagacagacaggttaattatactagttttgtataaaagagtcttggtaatcatcaatctttttggaagaaaaggaagtgttatgatgaaaaaagaagaattgaaacagctggctctccggatcggtaacgtacctgcccgctacgagagtaatgtggaagaataccaagaagatgaggttttgttttggtgggaagataagaatgatccggaagccggcatcatggtcgaattggaccgggacggaaaactgaaatccttatcccgtccggctttccggactgatctgccggctctttcggaatcggacatagaagaacggatgcgggcgtttgtagaaacccatcgtccgggggcattggctgagttcgaattggagaaaaaaagctccgcaaatgatggtgatgtgagatattcctatgttcagatggctgacggtctgccgcttccgctgaccgggttttacgccgacctgtctttgacaggggaagtaaccggcttttcttaccatgggaaggctgataatctcttaagacccggaacaattgcggacaagcgggaagcattggctcactttatcaaacatgttgaagcggagctgttgttcaccgtactgcatcagtccgtctatgtgcagggggatgacaagcctcatctcgtctatgaaatcgtgtctccgacgcggccgatatcggctgacctgaaggaagagaatgcagaaatagacgaatatgaagagctggaagacgacatgctgccgtatgtcccgatttcacgtcctgcccctgaagcggaaaagatgagcatcaatgacatgatcgggctgcacgacggtttttataaagagagggaaagcgatcttggagagggcagtatcggtattgcctggcgccctgaaaaaacaaaatccgtacgggaagataaaagttttgaaagtctgttcaaagagcggaatgaacatgtattgaaaacaaggtatgataaagaatcgggccggctcaccggggtgatgtcatttatacatagtgaaggcgaaccggagttttccgaggaagaatgccatcacatggccatccgctttttgttcgccatgtttccggaagcggatcagtatttccgggttcaatatgatgagccggatgatgaaggagaaaacgtgggacttacatataaggcttgttcgggcggcgttgatttgcgattcggagaggggagaatctgtgtcagcaaaaagacgggtcttgtcactgtatatatgccgccggaaattgatccgaaagagctggaggaaatcgatcccgttccttcattgacaatggaagaggcgaaggacgcgatccgccgggccatcaaagccgagctcgcttgggatcgttgttacgatgacggcagctgcggaaaagtgtacaggctcgtatacaagccggttttcccgcggtttattgaggcccatacgggagaagtgatcacgagtttaataggctgaaggtcatgggcgttcgtcccgggtcttttgcgggaagtgtgactattgtatgaaaaacagccgctctgaatacggctcttttccctctttgctaaaaatagacacataaaaggcactttcttccctttaaaaggataaggacgtttttatataattaaaaacagttcttttttatacactcttctgaaaggatgaccccattgctgaaagaacatctgagaaaaaaagcgctggagatcgggaacataccgccgcactatgagcttgaaatagaagattatgatgaaaaacaaaaaacgagagcctattatatatggaaagatcgtaaccatccggataaaacggtaacgattgagctgggcgacgacggatctttgcttacctattcacgcaacgactgtccgggttcagacatgcagctgtcagacgccgaattaaagctgacggctcttcggtttgcggcgagacaccgcccgcttacttttatgaatttcatctttcaggcgagggaagaacgcaatgggtgcatccgatttatctatacaaaaaaagtgctcggccggccgcttcccgattcaggttttttcgttgatgtaaccaggagcggcttcgtcgtgcagtttatctattacggggataagggtgaagcgcccgtcccggaaacattcgtcgatcgggaaaaagtcgtctcgcattatatgagtgtgctgacattcagtctcgtctatgatgtggtcaattttgagaaaataccgcgtctcgtctatgaaccgattctgccggcttacagctatccggccggtgaagatgatatcgtgccggatcagcagctttgcgaagacaggaatgagccggcaaaaccgcttcccgcgtttgaacataaacgggaaatcagcctggatgaattgatggggtttacctcggatatggttcagacgcgccggcgcgatctcggggatgagatcggaacgacatggcggaaagggtcggttccggaacggaaagatttgagtatcgaaagctattttgaaaccagcaacaaaaatacaatgaagatgaaaacggacaaaaagacagggaaaatgacagcctttaaatcttttattgagcatcagggcccggccttttattctgcggaagagtgtgaggccgtcgcgcttcaatttttatacaagctttatccgagagcggacgagttttttaaaatgaacccgctgaaaacggacggaaggggcaggttccgcttccatttttccgtatggcatcaggatattccgctgcggttcggcgctgcgagaatacttgtcagtcccgtaacggggcttgtggaagcttatatggcgcctgacattgacccggagcagctggagaagatcaatccggtgccggccgttactcccgaagaagcaaaggccgcttttttatccgatttccatctgcggctggagtggcagcgcgattttatgccgtccggcaatgaaggatataagcttgtgtacaggcctgtctatcctccgtacattgatgcgcagaagcgaaaaaagaaaaggttttattagccagggatcatttgtaaatgaggataatctttaaagcctctccaatcgcctccccaatcaaaaccgagcgttttggcaatcgatacgacctcaagccaatcgggcgtgccgtttcggtttccgtcgtgcgtcatatcccacatcaggcttccatcctttttttgcagggcgaagtcgatcgcaaggccgtaattgtggtaagattccccgccttttgcgtaggtgacgatatttcctttttttgaacgtccttgacggtacaattcgttttgttcctcaattgatctgaaaccctctgtgataacgacggtgatgccttttttcagagcggccgtccgcaatagctccgcattctgtttcacgagcggatgaagagcgcttggaatggctctatcttgtaatgccgtctgcggcctcaattctttctgcacataggaaaaacataggtctgcagaaaagaagaggatcagaagcagcgaaattctgactggtagtttcatggtgaattctctctttctttaattgattaaaatctttgtttgctcactgccataaatttgctatgataaaatataacataattagtagccggaggaaggaggcaaatctatgaaatccaagattccatctgaagaagtggccgtaaagatgaatgaatggtataagctgatccgcgcgtttgaagccgataaagctgaagcgctgaagcgggagattcaatatgaactcgaagatatggaagaaaatcaggatttattgttgtatttttcattgatggaatttaggcaccgcatcatgctggataaattaaaacccatgaaagacggcgactgccagcctccgttctctgaaatgctcactgagattgagatgaaccagcaaaagctgaccggcttactggaatattatttttactatttcagaggaatgtatgaatttaagcagaaaaacttcatctcagcgatttctcattataagcgggctgaggaaaagcttgaatatgtggaagatgacatagagaaagccgagtttctgtataaaatttctgaggtgtactatcatatcaagcagactttcttttcgatgaattatgcgggacaggcgcttgatatttacaagaaatatgaattatacggaatgagaagggtgcagtgcaaatttatcattgccggaaatctgatggacgcccagcagcataaaaaagcgctggaatacctcgaatgcgccttggagcacgcggagcggcttgatgatcaatatatgattgctgcggcctattataatatcgggcactgtatgtacagtctgggtgacttttgcaaggcggcggaggattttgaacgggcggctgccggatttgaagcacacagcttccggcaggtcatccaggctgttttttcactcacgcatatctactttaaaacggaaaaatacagtgaagccgccgccagctgcgcgcggggcatgagaagcgcggcggagtgggaagatgagatctatatgacaaaattccgtctgattaaagagctttatcagggggaaggcggacaggattcgctcaaagagtattttgacatcctggaatcaaaagagctgttggctgacacagaggaactgcttcaggacgcggctcatttctttcataaacgggagaactacaaagcggcatcttattttttcagcaggcttgtcggcgtgcaaaaaaggctgcaaatgaacaactacgcataatgaaaaaaagaacgagggagcttcggtttcatcgttctttttatgattccttttgttttcagccgattaaaaccgggtacatgctctgtattaacatcagggaggaaatgagacaatgtatcaggatttacagggaaaaacagcgattgtaacaggttcttcgaaaggaatcggaaaagccattgccgaacgcttcggcaaggagcggatgaatgtggttgtgaactacctcggtgattccgccggagcggaagaagcggcggacatcattgagaaagcgggaggcagagccgtcaccgtaaaagccgatgtatcctcagaagaagggattcaggcgctgtttaatgccgcgcaggagcatttcgggggcgtggacgtgatggtcaacaattccggctttaacggagccgaagcgatgccccatgaaatgagcctggaggattggcaaagggtcatcgacgtcaacgtgaccggcacctttttgggggcgaaagcggcactgaaacatatgctcgagcacggcaaaaaaggaacggtcttaaacatatcgagcgttcatcagcaaataccgcgtcctgaaaacgtgcagtactcggcatccaaaggcgggatcaaaatgatgacggaaacgatggcgctcaattacgcagacaaaggcatccgggtgaatgccatcgctcccggcacgatcgccacggagtccaataaggatctggaagatgaaacacataaacaggcccagctgaaaaaaattccgatgaacgccttcggaaaaccggaagaagtcgccgcggccgccgcatggatggtgtcggaagaagcgagttacgtaaccggaacgacacttttcgtagacggaggcatgacgctttatccgtcccagctggaaagataaaagaggaggggaaaccttctcttttttgtttagagaagggtcataaaggaaatggttctctaaaaaacaggagggccgcaagatggcgaatgactggtggaaagacgccgttgtctatcaaatctatccgcgaagcttccaagatacgaacggcgacggcataggcgacctgcgggggattatcgcgcgtctcgattatataaaagagcttggcgccgatgtgatatggatctgcccgatttacccgtcgccaaacgtcgataacggctacgatgtgacggatcatcaagcgattatggaatcatacggaacgatggaggactttcacgatctgcttacagaatgccgcagccgcggattaaagcttgtgatggacttcgttttaaatcatacatccacggagcatccttggttcaaagaggcggaaatgaatccggacagcaaataccgcgattattatatttggcggccgggcaccgcggagggcccgccgaccgattgggtgtcggattacggacaatccgtctggcagtacgaagaacatacgggcgaatattacctgcatatgaacgccgttaaacaagccgatctgaattgggaaaatcccgaggttcggcaatcagtatacgagatgatgagattttggctcgataaaggcgtggacggattgcgaatagaccagcttcatcttctgtcaaaaaaagaatacttgccgccatatgaagattacatcgcccgccgggcagatccgaagcctttccggccaaacggagcacggatacatgattacttaaaagaaatgacgaaagaggtattttccaaatatgacgtgatgtcggtcggcgaggccggatcagtgacgcctgaggaggggctggtttacacgggaaccgatgagcatgaactgaatatgatttttcattttcagcatatggagcttgatcaaaagccgggccaagagcattgggatgtaaaaccgcttgagctgtccgatttgaagaaagtgctcacagactggcaggaaaaactggaacatcaaggctggaatacgctgtattggtgcaatcatgaccagccccggatcgtatcccgcttcggagacgaaggcaaataccgaaaggcatccgccaaaatgcttgccgccctgctttatttcatgaaaggcacgccgtacatttatcagggagaagaactcggcatgacaaacgccccgtttgacagaatagaggactatcaagatattcagaccgtcaatatgtatcacaaaagggtatttgaaatgggccgcaacagggaagaagtcatggcgtccattatggcgaaaagccgcgatcatgcccgtacaccgatgcagtgggacggcagcaagaatgccggatttacggagggcgaaccgtggctgaaggtcaatcccaattacaaaaccgtcaatgcggccgaggctcaggatgatcccaattctatattgaacttttacaaaaaactgatccgcctgcgaaaacagtatgctgatatcataaaaggcagctacacgctgctgtttcccgatgacccgcagctgtttgtgtatgaaagacaggcaaacggacaaaaaatcatatccatcagcaacgtatcgaaagaagaagccgccttttattggccggacggctccgaatctgaaagggccgagctgcttctcagcaactatgaaaataacggcggagcggaatcccgcatcacgttccgcccttacgaaacaagagtttatctgcatgcctgatatgtgatacgacgccccgtccatacatggcgggggctttttaggtaaatcggttatcaatttagaaaaaaattacttgcaaaacgtaattacttcgttttattatggtataggtaacaaatgaacgagaaagtacgctttggaaatcgtcatcattctgatttacagaacagggggaaacggcttgtttaaaaaatggagcggaatcattgtcattgcggcatgctttttaatcgcggcgggctgcggcaattcatcttcaaaaggttcgtcaggttcttcgaaaagcggcaaactgcacgtcgtgacgaccttttatcctatgtacgaattcacgaaacaaattgtcaaagacaaaggcgatgtagacattctcatcccgtcttcggtcgaaccccatgattgggagccgacgccgaaggatatcgccggcattcaaaatgccgatcttttcgtatacaacagcgaatatatggagacatgggttccttcagcggaaaaaagcatgagctctgatcatgcgaagtttgtaaaggcgtcgaaaggaattgacttgctcgaaggttcggatgaagaggaagaggaacatggacacggcggtcatgaccacagccgcagcatggaccctcacgtgtggctcagcccggttcttgcgcaaaaagaggtcaaaaccattacggcgcagatcgtaaaacaggacccgaagaataaagcatactatgagaaaaatagtaaagaatatattgcaaaactgcaggatcttgataaactataccgtacaacattaaataaagcgtcgaaaaaagaattgatcacacagcacgcggcattcagctatctcgccaaagaatacggcttaaaacaagtcgcgattgcaggcctttctcctgaagaagagccgagtgcggccaaactggcggatctcaaaacgtttgccaaaaagcatgatgtgaagatcatctactttgaagaagttgcatcgcctaaagttgcagatacacttgccggtgaaatcggcgcgaaaacggaagtgctcaatacactggaaggtttaagccaaaaagaacgggataaaggcatcggttatatcgacattatggagaaaaaccttgatgcactgaaagattcgctattggttaaataacatagtgtgcgccgcggggtgcacactatttctatgcgggaaaggaaggtcagcatgaatctcgttacattacaggatatcgtttttggttattcgcatacacccgtgcttgacggcgtgtcgctggaaatcaaaagcggcgaattcgtcggcattacaggaccgaacggcgcgtcaaaatcgacgctgatgaaagtcatgctcggcatgctcagaccttgggaaggaacggccgagatcagtaaaaaaaacgctgccggaaaacgcctgacaatcggctatgttccgcagcagatttcttcatttaacgcaggattcccaagcacagttctggagcttgtgcaatcaggccgttatacgaaaggaaaatggtttaaacgattgaacgaaacggatcaccacgaggtggaaaacgcgctgaagatggtggaaatgtgggatttccgccaccggaaaatcggcgatttatccggcggacagaagcagaaaatctgcattgcgagaatgcttgcaagcaatccggatctgctgatgcttgatgaaccgacaaccgcggttgattatgagagcagacagggtttctacgaatttatgcatcatcaggtgaaaaatcacaaccgcaccgtcgtcatggtgacacacgaacaaaacgaagtacagcagtatctggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcatatttcattgtcgggcgtggccatcggtttttttctcagtaccaatattacggcggcgagcatcgttgtcgtcacgatcggagcgatcggcatcgaatatatgcggcgggcataccgtacatattcagaggtatccatcgcaatcttaatggcggccgggctgtcgtttgcgatgtttctgatcagcctgtcaaaaggcggcgcgtcgatgagcatcgatcaatatttatttggatcgcttgtcacggtcagccagcagcaggtctatattatcggaggcattaccctgctgattctgctttatttcattatattaaacagaccgctctatctgcttacctttgacgaggcgacggcgaagacatcaggcattaacacaaatctcctgtcaatgtcattcagcatcgtgacggggctggcgatttcggtcattattccgattatcggcgtgctgcttgtttccgcgctcctcgtactgcccgcggcttttgcaatccgtatcgccaaagggtttaaatgggtgtttgcggcggccattattatttctcttttcagtgtgttcatggggctgacgtcttcgtaccagctcggaacgcctccggggccgtcaatcactttactgttaatcattctgcttctgctcggctttatgctgcaggggatttggaatgcgtttaaaaaaggaaaagaacgaaaaaaccgccgttaagcggtgcagcagtctcatctgctgcgccgtttgacggctttttttacagaaatatatcagcaagacgctcatatgactctttttttgcttcgaaatcaaagacgttgcacagcaccatcatctcttttgtctgataacgttcggaaagttcaagcagacggcgtttcactgcggcagcagagccgatcaccatccgcttcctattttctgcaatctgtttacggtcctccggcgaatacggataagccttcgcttcttccacactcggcacgcggctgtcggcgccttttccgatgcgaagaagccataaatcctggcttaaggcgagttcttccgctttctcatccgtagctgcgcatatgacgaaaatggcacagagtgaggccggagcggaaaaatgggaggaggcccggaaatggtcccgatagatctgaaaggcttttaccccgcgttccggattaatgaaatggccgaagacatagcccgcaccttgaagagcggcgcgtctggcgctgttttccccgaggcccagcacccaaagctgcggggctgtttcaatcaaaggcgctgtttttattccggcataagcatggtccgagggaaccgaatctgtcagaaaggatgataaatcctgaagctgcctgttgaactcggtcatacttttctttaccccgtctgtgagggcgagccggattttcgtcgtgccgcccggtgagcgtccgaccccaaggtcaatccggttcggatgcagcgcctcaagctgacggaaagtttccgcgactttataggggctgtactgtggcagcagcacgccgcctgatccgacacggatggacgttgtggctgcggcggtatgagcgatcataatttccggcgaaacgcttgcgagccctcttgtgccgtgatgctcggcaaaccagtaccgcttatagccccatccttcgctgaggcgggcgagctccgctgaacggcggagcgtctcgtgcggcccgtttcctttggatacgggcgcctgatcaagtatgcttaaatcaatcactcgtctgcccctttcctgacatgtattgatacaaggataggaaaaatgttcagtccccgtcaatttctttgttttctctattctctccggaacgaaggagaatataggaagtaatttttcgccgtttttcgccaaaaattcttatgttttatgaaactttgatataataaaagacgtataacttaataaacaccgggattcttgtcccggaatttagtaaaaatgcgcacttgcggcgtgcttagcggcacccttacagaataggagtgaatcatatggcgatctctttacaaaaaggacagcggattgatttaacaaaaggaaaagccggcctgtcaaaactgctggtcggactcggctgggaccctgtatcatccggcggctttttcggaaagctgttcggcggaggcggtgccaatatcgactgtgacgcttccgtactgatgcttgaaaatgataaaatgacagacagcaaaaacgtcatctatttcggcaatctgaaaagccggtgcggcggtgtcgtacatacgggtgacaacctgacgggtgaaggcgacggcgatgatgaacaaattctcatcgatttggcgaaagtgcccgctcagattaataaacttgtgtttgtcgtcaatatttacgactgcgtcagacgaaaacaggacttcggcatgattcaaaacgcgttcatccgcgtcgttgatcaggctaatcgcgaagaactggtgacttacaatttaagagataactattcaggcagaacgagcctgatcgcggctgaaatctaccgcgaggacggcgagtggaaattcgccgcagtaggagaaggcacaaacgatacaaaaatcggcgatatcgttaaccgatacgcctaaacgataaaaaggagagtgcacacatggcaatttcattggcaaaaggacaaaaagtagatttgactaaaacaaatccgggtctttctaaagtcgttgtcggccttggctgggatacaaacaaatacgatggcggacatgattttgatttagattccagcgtctttctattaaatgaagcaggaagatgcgcgtcgcccgatgattttattttctataatcagcttgaaggcggaaacggctctgtcgcacattcaggcgacaaccttacaggccagggcgagggcgatgacgaaagtgtaagggtcaacctgagcgcggtgcctgccgctattgacaaaatttcattcgtcatcacgattcatgaagcggaagcgcgcggccaaaacttcggacaagtttccaacgcgttcgttcgcattgtcaatgaagagacaaatgaagagctgatccgctacgatctggctgaagatttctcaattgaaacagccattatcgcaggggagctttacagacataacggcgaatggaaattttccgcgatcggctcaggctatcaaggcggactggcccgtattgcgacagattacggcctgcaaatcggctaaaaccatatcaagcacagaagggagagacggcacatggctattcaattggcgaaaggacagcgtgttgatctgacaaaaacgaaccccggtcttacaaaagcggtgatcggcttaggctgggatacgaacaagtactccggagggcatgactttgaccttgacgcgtcggcttttcttgtcgatgcccatgacaactgtgttaatgatcttgattttgttttctacaataacctggaacacccgagcggcggcgtcatccatacgggagacaaccggacgggcgagggagagggagacgatgaacaaattatcgtcgatttctcaaaaatacccgcaaatattgaaaagatcggcatcaccgtcacgattcatgatgcggaagcgcgcggccaaaatttcggacaagtttcgaacgcgttcgtgcgcgtcgtcgatgaaaacagccagaatgaactgcttcgtttcgatttaggggaagacttctcgattgaaacggcggttgtcgtttgtgagctttaccgccatggggctgaatggaagtttaacgccatcggcagcgggttttccggcggtctggcatcactttgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaagggctgctgtcggccgacaatgcgttagtgcttgcggttatggtaaggcatctgcctgaaaaacagcggaagaaagcattaacatacggattgttcggggcatatattttccgctttatctttatcggaatcgggatgctgctcattaagttctggtggatcaaagtgcttggcgcgctgtacctggcttggctcgtcattaagcatttctggatcggagaaggtgatgacgatacggaaggcatgaagaaaaattcatggatggtccgtacgttcggaattttctgggccactgtcgtttcagttgagttaatggatctggccttctctgttgacagcattttagccgcgtttgcggtatcggaaaaagtgtgggtgctcttgatcggcggtatgctcggcattctcatgatgcgtacagtcgcaaaagtattccttgtgttaattgataaaatccctgagcttgaaaacacggctttcgtgctgatcgggattatcgccgtgaaaatggcggcgagcgcttttgattatgaaatgccgcacgtggtgttcttcggaatcatcatcgctgcatttgtggtcacgtttattatccactatttcaacaaacaaaagcaggttcaggagcagacggctgcatctaaagaagaataaaacaaaaaaggagggagagttcatttccttccttttttgtaccgattatcatgaagagaaaggaggaaaatgatgaagcaggaagaattggtgatccgaaaggccgagccggaaaacgatgactgggaaacgtttctgatgcggccgctgccggaacgtcccggttacgagcgggaaaacgggctggcgtttacccggcttgccggccggattttgggcactccttatgatgagacggagtattacagtaagcttttcgagctgtcttctcatgaaaacatccatgtgttgagcgagacgctggataagaccatcgcgccggaaacgtttcaggcgctgcagcacattcattcggtcaatcaaaaagagaaagggctttcggtttccaggtttgtcgcgtttctcgatgggggcaggctgcttgccaaacacgctgatccgcttatgcaccgccggctgaggaccgcgtttatgacgcttttggaaacctttgcggaccggcatgaaaacgggctgaatcatcccgatttccggcgtgtgctcttggatgtgtcaaagttttcgctgaaccacctgaatccatggctcgaacaagccgatatagagtgtgagatgccgaaggtggtgtggtatggagacgcgaccaaaagccagctctattttctctattatctcatgctgatcggctgtgatgtcctattgtttcatccggctgcggaagatccgttcagcttgattgatccggatgaggagctcagctttgtgataaagctccccgcaacaggcggtcttgagccttttccgaaagaaaagccggacagaacgtccacgacggcctaccggtcaacgaaagaaattgagcatgtgctgaaccatgaggaatccatgatgtataagccttggcagttcagggagcacaccccgcagtccgtgaccttaaaaacgacgtatgatgagttatttctcattgcgaaggagcgggcgtttatccggccgcaatttaaagcggacagggagcgggtggccgttccgaacctttttgcgaaagtgatgggggtttccaaagatacgaaagaatattggaacagactccataccgccgcggactatcaggagacacacatgatccgcagttttccgtttacggaagagctgaaagccaactaccagtatcactacagtcaggttttaaatgaaaaaggagagattgacgcggacaggctgaaaagaagcaacatctggcagtacaagcatctgccttcaggtgtgcagagcgccatcgccaatgtgatttctgacatgtgcagaaacccagggctgaaggctttgcccggggagcagtcaagggatgccgcaatctatttgttccgccaggcgacgaatctgcccgcttcgctgctgcaattgattcagacgtttgattacgcccaaaccgttccgaaactcgttttatatcatacggaacaaaatggcgaactcacacgttctgatgccgccgctcttttgtttttaaataaattcggcgtcgatatcatcttgtataatccgccgggccatcaggacattgagcattatattgaagaaagccaatttgatgtccattggctggaggacatggtgtttcggcaggaatataaggagccgtcactcgtaagaaagctgtttagaaccattacgcaaaagcagggagagtaaataaatatgacagaaaatcaaaatccgcttgttcttgataaaaatgaagagatttctgaacaaaaagcagatgacatcagggcgcagctgcgccaagaccctgaggtgcagcgcatttcgcagcagattgacgtgaaaaaccaaatggagctgcttgagtacggaaaagaaccggcagttgaaatctcgaagttctccgaccgcatcttaaatatgatgaaaacaacaagtgtcacggattcaggcacaatgctgacgcagctcggaaaaatcatggaccgtttcgacaaaaatgatttcgatgaaccaaaaggatttctcgctaaaatgttcaaacgcggcaacagcatgattgaaaagatttttcaaaagtaccgcaccctgggcggagaaattgaaaaaatccacgtcgaaatttcaaaatacaaagatgaaatggcaaagacgaaccatacgcttgaagagatgtatgaaaacaacattaactactacatggagcttgaaaaatatgttgtcgccgggcagatgaagcttgaggaaatgcaggcgctcattccttcttatgaagaaaaagcggccggcggaaaccagcttgcgcaaatgcagcttgatacgctgcgtgacgggcttcaggcgcttgaggaacgtgtctatgatttagatatggcgcggatggtggcgctgcagacagcgccgcagatccgcctccttcagcgcggaaatacgaagctcatcggaaaaatcaattccgctttcgtcattacgattccgattttcaaaaacggcatcattcaggctgtcacagtcaaacggcaaaagcttgtggctgattcaatgagcgagctggaccgccgcacgaatgaaatgctgaagcgcaacgctgaaaatatttcaaaccaaagcgtggagattgcccgtatggcaggccgtccgagcattgacattgagacgattgaaacgtcttggaatacgattgtcagcggtatgcaggaaacgaaacagatcgaggaagagaacagacgtatcagagaagacggagcgaaacggattcaacagcttcaggataatattaaaaacgcagtcttaaagaattaacacacagcccgcttgcttacggcaagcgggttttttttgcgaaaaaagataatgacaatgtgtaaagacaggtgtaaacttatacggtaatcattttcgatttgaggtgctgcttatgaaccaacaacctgccgtcactccgcgaaaacttctggcgattgccggaatgggctggctgtttgatgcgatggatgtcggaattttatcgtttattatcgccgcgcttcacactgattggaatttaacacccgatcaaatgaaatggatcggaagcgtcaattccatcggtatggcagcgggcgcctttgtattcggaatgctggccgacaggatcggccggaaaaaagtgtttatgatcacgctgttattcttttctgtcggaagcggcatatccgcttttgcaacgggattgacggtttttctcatattgcgttttctgatcggaatggggcttggcggggaactgcctgtcgcctcgacgctcgtgtcagaagcgtccgctcccgaaaagcggggacggatcatcgtgctgcttgagagcttttgggcagcgggctggcttcttgcggcggtgatttcctactttgtcataccgtcattcggctggcaggccgcactgctcttaacggcgctggccgcgttttatgcgctgtacttgcggaaaagccttccggaatcaccggcgcatcaggcattgacgcagaaaaaaagcatacgcgggcaggcgggaagtgtctggacgaaaccgtatatccggccgacggtgctgctgtctgtcgtttggttctgtgtcgtcttttcttattacggcatgtttttatggctgccgagcgtgatgctgatgaaaggctacagcatgattgagagcttcgaatacgtccttctgatgacgcttgcccagcttcccggatatttctcagcggcgtggctgatcgaaaaagcggggcggaagaccatcttagtcatctatttgctcggaacggcgggcagcgcttatttcttcggtgccgcggattcattggccatgctgctcacggctggcatgctgctgtcctttttcaatctcggcgcatggggcgtgctttacgcctatacaccggagcagtaccctgcggcgatccgcgcgaccggttccggaacaaccgcggccgtcggcagaatcggcggcattttcggtccgcttctcgtcggatcgcttgcagcacggaacgtttcgtttacagctattttcgctgtcttttgtgcggccatcctgattgccgtcatcaccattattattctcggaaaagaaacgaaacagacagagcttgcgcaatgagcacccttttggggtgctttttttagtgagctgtctgttggcagacctatatttttccttaaaatcccttattttcaggaggcgaaaacttctttttccgggacaatgtcgcaaaaaaattcttgtatttgtaaaaaaaggataggaaatcagtttgcagcacattcgatggaaacgttctcaagcctgataaaagcccgatttcctttataatttatcctcaataaggaggattagagagtatttagaagcatatcagaggaaaataagacacagggatgtttttaaagtaatgatacaaaataaacgggattatgatgtttgtttgacttattacaaacgtgttacggtattaaagattgcttattatggagggaaaatatgaatttggatgagaaaccaattaagataaaagtcgaaaatgtatctaaggttttcggaaaacagacaaaaaaagccattcagatgctgtccagcggaaaaaacaaaaaagagatcctgaaagcgaccggatcaaccgttggtgtcaatcaagcaaactttgatgtatatgatggggagatatttgtcatcatgggtctatcggggagcggtaaatcaactttagttcggctgttaaaccggcttattgaaccgactgccgggaatatttatattgatggtgacatgataacaaatatgtcaaaagaccagctccgggaagtgcgccggaaaaaaatcagcatggtctttcaaaaatttgcgctgtttccgcacagaacgattcttgaaaatacggaatacgggttggaactccaaggcgtcgacaaaaaagagcgtgagcaaaaagcgcttgattcgcttaaacttgtcggtcttgaaggctttgaacaccaattcccagatcagctcagcggaggaatgcagcagcgtgtaggacttgcccgcgcattgacgaatgatcctgacattcttctgatggatgaagctttcagtgcgcttgatccgctgatccgcaaagacatgcaggatgagcttttagaccttcatgactctgtcggcaagacgatcatcttcatcacgcatgatcttgatgaagcattgcgcatcggcgacagaatcgtgctgatgaaagacggtaacatcgttcagatcgggacgcctgaagaaattctgatgagcccgtccaatgaatacgttgagaaattcgttgaggacgttgacttatccaaagttctgacagcgggccacatcatgaagcgcgctgaaaccgtgcggattgacaaagggcctcgtgtagcgctgcagctcatgaagaatctcggtatttcttctatttacgccgttgataaacagaaacagcttctcggcgtcattcacgcggcggatgcgaaaaaagcggtggaatccgacttatcgcttcaggatattttaaatactgaatttacgactgtgcatgaaagcacatacttgacggaaattttcgatgtcgtgtctgatgcgaatattccgatcgccgtcacggacgataaggaccgcatgaaaggcattgtcgtaaaaggcgcattaatcggcgcgctttcaggaaataacgattatataaatgttgaagattctgctgaacaagctcaggattcttctgttcagggggtgaagtaaatggacagattgcctagaattccgttagcagatatcgttgaccggtttgttgactggcttaccatgacgttcggaggtttctttgatggaatctcaaacggtttggccgctttcgtaaacgcgattgtgagcggtttgggtttcatcccgtctattttattgactgttatttttgcagctctcgcttggtggatcagtacgagaggaattgcactctttacgttaatcggattccttgttattgattatttgggttattggtcgccgatgctgcaaacgttggcgcttgtcgtcacatctgttttgatttcgattattatcggggttccgatcggcatatgggcgtctcagaaagaaacagtccgccgcattgtcacaccgattctggatttaatgcagaccatgccggctttcgtatacctgctgcctgcaattttcttctttaatatcggggttgtgccaggcgttgtggcatctgttattttcgcgatgcctccgacgatccgcatgacggttctcggtattaaacaggttccggctgatctgattgaagcgacggaagcattcggttcaacgacgtctcagcgtctgttcaaggtacagcttccgcttgccacaaaaacaattcttgccggtattaaccaaagcatcatgcttgctttgtcaatggtcgttatcgcggccatggtcggtgcgccgggtcttggttctgaagtatacagcgccgtgacacagttgaaaaccggtgtcggagtggaagcgggtatcgcgatcgttatcgtagcgattacactcgaccgtatcacgcaaaacattaaagtgaagaagaagagcagggggaatgcctgatgcttaagaaaatcatcggtgtcggcgttaccgctgcgctggctctttctttggctgcctgcggttcgcagactgatgataaggcaacggctgcggaccaggtgaacaaaaccattatcggtatcgatccgggatcggggatcatggccctgacggatgaggccgtgaaggattacggattgaaagactggaatgtcatcacggcgtcaagtgccgccatgacggcgacattgaagaaatcatatgaccggaaaaagccgatcatcgtaacgggctggacgccgcactggatgttctccagatacaagctgaagttccttgatgatccgaaaaaaacgtacggaactgccgagcagattcatacgattacaagaaccggcttcagtaaggaacagcctaacgcggccaaagttctcagccagttcaaatggacgcaggacgatatgggagaagtcatgattgccgttgaggaaggcgaaaagccggccaaagccgcagctgaatatgtgaaaaaacataaagaccaagtggctcaatggacaaaaggcgcccataaagtcaaaggggataaaatcaacctggcttatgtggcatgggacagtgaaatcgcaagtacgaatgtaatcggaaaagtatttcaagacctcggctatgacgtgaagctgacgcaagtggaggcaggaccgatgtggactgcgattgcgacaggcagcgcggatgcgtcattgtctgcttggcttccgaatacccataaggcatatgcgtctaaatataaaggcaaatatgaagatgtaggaacgagtctgacaggcgtcaagatgggtctggtcgttcctcagtacatgaaaaacgtcaattcaattgaagatctgaagaagtaatgaagaaaagcagccctgtaacgggctgcttttttttatgcttcaaacgatttgaggacggcgtccgttaatatctcagcgccagtaaagatggcgcttcggtcaaatgtcatttggggatggtgaagtccaggctccaggccgcaccctaggccgagcatcgtcgttttcaagttcggaacctttaacccgtaaaagtgaaaatcctctcctccggttgtcacaagaggttcatccacatgttcttctccgagaatgctgctgatcgcagatgccatgatggcttccgcctccttgtttcgctcggctgccgggaggctgtgttctttttgcagttcgatttttgcgccgaatgcggcagccgccgcctcacaggctctttcggtttcggcggttaatttctccatggcggcattggtttgtgcgcggagatcaaggctgaacgatgcttttcccggaatgatattggaactttctccgcctgcctgaagctttgtcatcttcacggaatgcgggatgccgggatcaagatgaatgaagctgagtttttggacgagaagagcggcgatttcgatactgttaagcccgagatgcggtctcgcgccgtgggcttcttctccgataatcaggccttctatatgccggcttgagccatgcagaatggacggtgcgcatcggccgtttgccgtttcctgtacggggcgcacgtgcacgccgtataagaagtcaacatcatccagtacgcctttttcaatcattttcagcgctccgccgcctttttcttcagccggctgaaaaataaagcggatggtgcccttcggaagcttcggctgactctttaaaagcatcatcgtgccgagcgccatcgtcatatgtgaatcatgtccgcatgaatggttcgcctgaaagacaccgtccacttcctgccacagcgcgtcaatatccgcccggacagccacaacgggcgagccttctccgatttcgccgacaacaccggtgcaatcatcaaacgtacggattcggcagccggcctctttcagtttttcagtcagatattcagttgtttgatattctttccagcttacttcgggattggcgtgcaggtggtcaaaaatgtccataatgacttgcttttcatgctctgtgagtctgttcatgccgtaagtcctccttcaaaagctgtctgttttttatttttgatattgaaaacaggcaatcggtctgtatataatatagcacatatctgtattttctgaatagtttataaattcaaagtgggatggtgatgttatggctgtgccgaaggccgaacctgtattgaaaaagaagaaattgtttgtgatgcctgatgcttatgtgctgctgttcattgtcgctttactatgcgcgatagcatcatacatcgttcctgcgggggaatttgacagggtgacaaagggcagtgtgacgtccgccgtcccgggaagttatcattctttagaccagtctcctgtcagcccgatcgctttttttaccgcgattcaggaagggatgacaagttccgcgccgattatttttttaatcctgtttacgggcggcaccattgcgattttggagaaaacgggcgccatcaatggattgatcagtaatgtcatcagtacgttccgcaccaaacagctgctgtttattgcaattgtcggatctctattttcgatcctcggcacaaccggcatcgtcgttaattccgtgatcggttttattccgatcggcctgatcgtcgcccgttcgctgaaatgggatgccgtggccggagcggccgtcatttatatcggctgttatgccgggtttaacgcgacgattttatcaccttcaccgctcgggttatcacaaagcatcgcggagctgccgctgttttccggcatcggcctgcggattgccgtctacatttgttttctgctatcatctattttatatatttatcggtatacgagaaggctcagaaaagcaaaggacgccagtctgctggggaacgattggtttccggcagcaggttcaatcccgcaggcttcagatccggaggacaagccagtcccgtttaccgtccgccataaattgattctggctgtcgcggctttgtcgcttgccggctttttatacggcgcgcttactcttgactggtctgattcagagatggccgccgtgttcatttttatctcaatcgtgtcaggcctgattgcgggaatggcggcaaatgatatcgcaaaaacgtttattacaggctgtcaggggctcgtttacggcgcgctgatcgtcggaatggcgagaagcatttccgttattctggaacacggaaagctgcttgatacggtagtcaatggacttgcgtcactgctgcacggtttcagcccgatggcaggcgcaatcggaatgtatatttccagcgccctgcttcattttctgatatcatcgggctcaggggaggcggtcgtatttattccgattttggcgccgcttgccgatctgatgggcatcacgagacaggtcgcggttgaagcggtcatgcttggggaaggcgtcgtaaactgtgtcaatccgacttccggcgttctgatggccgtactggctgccagcggcattccgtacgtaaagtggcttcgcttcatgattccgctggcgctgatttggtttgtcatcggccttgtgtttatctgcataggcgtcctgatcaattggggcccttattaacatttttgtcaatgatatttcggtttatcattatgaatcggcaagatataatgggagttgtaagccattcttaatagtacgggaggaagtcatgaatcagcgtcggaacagactttcaaacgtgaatggaaagagtgagagtgtgaaagagaaagaacgaatgatttggtcagaagtcggaatgcttgtgggcacactgtctttgcttgacatcatcgtacgcggacttgttctgaactgtccgtttagggaatgggccggaagcttggcggttttcttcattataattgtttattattgcatcagggcgggagcgtcgggaatgctcatgccgagaatagacaccaaagaagaactgaaaaagcgggtgaagcagcagcggatagattcaatagcagtcacttttgcggtggcggcgcttacgatgtacgacagggggtttccccatacattctttgcttggctgaaaatgatctttctttttatcgtctgcggaggcattctgtttctgcttcggtatgtcattgtgaagctgtcttacagaagagcgataaaagaaataaaaaagaaatcatcttgacaggtggtttctttttttgtttgaaagcgggaagtctttttaattgataggaatatagatttgaattcactctgccgcgttgctttgatagagagagtatgataagttgaaatgtaagcgttaacagaattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggcccggcggctgcaaacgctgaaactgcaaacaaatcgaatgaggtggccgcgtcatcggtcaaaaacgggaccatccttcatgcctggaattggtcgttcaatacgttaacacaaaatatgaaagagattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaaatatggcgtaaaagtcattgttgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaaacctatctgaaacgtttcttggaaagagcattgaatgacggagcggacgggttccgctatgatgccgccaagcatatagagcttccggatgatgggaattacggcagccgattttggccgaatatcacaaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctcccattatgcatctgacgtgtctgcggacaagttggtcacatgggtggaatcacatgatacgtatgccaatgatgaggaagagtccacatggatgagtgatgacgatattcgtttaggctgggcagtgattggttcccgctcaggaagcacgcctcttttcttttccagacctgagggcggaggaaatggtgtaagatttcctggaaaaagtcaaataggagatcgcgggagcgccttatttaaagatcagacgatcactgcggtcaatcaatttcacaatgtaatggccgggcagcctgaggaactctcgaatccgaatgggaacaatcaaatattgatgaatcagcgcggctcaaaaggcgttgtgctggctaatgcgggatcgtcttctgtcaccgtcaatacttcaacgaaattgcctgacggcaggtatgataatagggccggcgccggttcatttcaagtagcgaacggcaaactgacaggtacgatcaatgccagatccgcggctgttctttattctgatgatattggaaatgcgcctcaggtctttcttgagaattaccaaacgggggcagtccattctttcaatgatcagctgacggtcaccctgcgtgcaaatgcgaaaacaacaaaagccgtttaccaaatcaataatgggcagcagacagcatttaaggatggagaccgattaacgatcgggaaaggagatccaatcggcacgacatacaacatcaagttaaccggaacgaacggcgagggtgcagcgagaacccaagaatacacgtttgtcaaaaaagacccggcccaaaccaacatcattggctatcaaaatccggatcattggggccaggtaaatgcttatatttacaaacatgatggaggcggggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccgggcagaaccagcccggatttgattatgtgcagaatggtttgtataacaactccggtttaaacggttatcttccgcattaatggatagggctatcatcacatcagcgtgccggcaaaccctcgcttctgggaaaaggacagcacgtcttcaatcacgctgaaaagatacaacatcctaaaacggttccgttttaggatgttgtcaacaatctggaaaccatcatcgatattttttgtccaaaaatcaaacttttctcttgcaaaagtttgtgaagtgttgcacaatataaatgtgaaattattcacaagttaaaaacagacaccacgaaacactggaggatgagcatacatgatgaacgaacgagtgaacaaagtagcattaatcggagcaggttttgttggaagcagttatgcatttgcgttaattaaccaagggatcacagatgagcttgtgatcattgatgtaaatagagaaaaagccatgggcgatgtcatggatttaaatcacggaaaggcatttgcacctcatccggtgaaaacgtcttacggaacatatgaagattgcaaggatgccgatatcgtatgcatctgtgccggagccaatcaaaaaccgggcgaaacgagacttgagctggtcgaaaaaaatctcgccatttttaaaagcattgtcggtgaagtaatggcaagcggatttgacggcatcttcctcgttgccacaaacccggtcgacattctcacttatgcgacatggacattcagcggtctgccgaaagaacgcgtcatcggcagcggcacgacactggattctgcgcgattccgttatatgctgagtgaatatttcggagccgctccgcaaaacgtacacgcccacattatcggcgagcacggcgataccgagcttcctgtatggagtcacgccaatatcggcggagtgccggtgcagcagttgctggagaaaaatgcagcttacaaacaggacgagctggatcagatcgtggacgatgtgaaaaacgccgcctatcatattattgagaaaaaaggcgcgacatattacggagtggcgatgagcctcgcccgcatcacaaaagcgattttgcgtaatgaaaacagtattttaaccgtcagcacatatctggacgggcaatacggtgtaaacgacgtctttatcggcattccggctgtcgtcaatcggaacggcatcgccggtgtgacggaacttgagctgaatgaaacagaacagcgtcaattcaaccatagcgcaaacgtgctgaaagacattctcgctccgcatttcgcggagtaaacaaaaaagcagtacatgacaaacgccatgtactgctttttttaattcgcttttttcgccatttcctgagaggtttttactctcgcttttcccataaacaaaatggtaacggccgcaatgacgatcggcgccagcgcaagcgtgaatacatatgtgatgctttgcgacatggcgtcaataatgcgatccagaatgtgcggcggaatatgggcgcgcgtgccggcctggaaaatctcctgcggatttccgatgttctgcatcgcgccgcccgctcctttcatgccgctgaatgaatctgtgagcttgttggtaaacacattcgtctggatggtcccgaaaatcgtcacaccgagcgtcataccgaatgatctcaaaaacgagtttgttgagttggcgcttccgcggtaacgcggctccagatcgttcatggacgcagccggcagcagtgagaagttgaagccgacgccgaatcctgagatcagcatgaataccgtcagcatcgtacgcgccgtatccggtgtcatattggaaagcagcagcattccgataaagaaagcgaccacggaaatcagcattaaattgcggaaccgcactttcgtctggaaaattccgccgatcatacttccgataacagaaccgatcatcatcggtgtcaaaataaagcccgcgcttgtcgcggtgcttccgtacacggcctgaacgaagatcgggataaacaccgctaaaatcacaaatgtggctccgtaaaggaacgccagaatctgtgccgtggcaaataaacggtttttaaacatccaaaatgagataatcggttcttccgcttttctttccacgataaaaaaggcgataaagaacacggcgaacacagcgaacagaccgatgatctgcacggagttccaatcatacgtttttccgccgagctcaagagcgaacatcagaccgacaatggaaaccaccagcgtaatcgcgccggcccagtcgattttctgcttcttgtgttcaagggattctttataataacgaagaatgaaaaacaatgataaaataccgatcggcacgttgatataaaacacccagtgccagctgatggagtcggtaatgagcgcgcctaaaagcggcccgagaacgctggaaaggccgaaaacggcaccgaacatgcccgacatttttccgcgtttttccggcggaaataaatcaaaaatgatcgtgaaggcgatcggcatcagcgcgcctccgccgattccctgaatgacgcggtaaataatgagctgatccattgtttgagcgattccgcataatgcagatccgattaagaaaagaataagaccgaataaaaagaaacgcttgcgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaacttcgtcgaggcgtccttcgcggctgtttgttccatgctttttcctcccatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctgtttcatcaggcggccgctcaatctctcggtctgtttccgaccgatttgaaatcagctgatatcttaaatgaagcaggcccgatgaccgcaggcgagctcgggaaaaaaaccggcctcagcacaggttcggtaacggcgctcattgaccggctcgaaaaagcgggatatgtcatgaggaaaaaagaccccgaagacaaacggcgggtgatcatcgtgccgctgacagccggaaaagcgaatgtgaagcaattattcagctccttatcccagtccacgatcagcctttgccggcaatataaagaagaagaactgcggctgatattcgattttttaggaaaagcgacggacatgatggaagacgagcttgagaaattaaaataatgtatcatagcacggcccattcatgaataacttgtacaagttgcatgaatgagggggaagccaatgaacatctttttaagctacatcgttctcgggctgtcattgtcagcacctgtcggaccggtcaatgcggcgcaaattgacaaaggcatcaaaaacggcttttggcatgcatggattttcggtctcggcgccatggccgcagacgggctgtatatgattctgatctatttcgggctgtctcaatttttgaccgctccttttgtaaaaacgtttttgtggctcttcggttttttcgtgctgacctacacgggagtcgaaacgttaaaaaatataagggaagccatgaatgtcagaagcggaaaaggaaaaccggctttttacaaaactttcggcgcggggttttttatttctctttccaatccgctgagcattttattctggctcggcatatacgggagcattctcgccaaaaccgctgaatccttcgatgcaaatcagcttttgatttacagctccggcattcttctcggcattttgatctgggatttctgcatggcggtcgccgcgagcactttcagaaatctccttcatgaaaaagcgctccgctggctgacgggagcggcgggtgtgtctttgatcgttttcgggttttatttcggatggcaggggattcaaatgctcatctcataaatagaaggactgtcacccatcgcctgtctccgtcataacgtatcatgacgatactggaggtgggccgatggcaagcgggctgtacacaaaaagttgccttgaggaaaagttattggatctgccaaattggcagagaatcgcttttgagcttctatcagaaaaagtaggcgataaagcggatacgtttccgtgcattcccggacgtcagggatttttgacagatcagctccggatatcctttgcgggtgatccccgcgaagagggaaccccggaggaagtggggatgctgctgtctgagtacggaaagatctcaaggaataccggaagatacgcgtcgctgcttgtgatttttgatacgcctgaggatttagctgagcattattccgttgaggcgtatgaagagctgttctggtcttttttaaaccggctgagcggctgcgacccgaaagactggccggaagacatgccggaagaccctgaacattataaatgggagttctgctttgacggcgaaccgtattttattctgtgcgcgacgcctgcgcatgaagcgagacaaagcagaagcttcccgttttttatgctcgcgtttcagccgagatgggtttttgaaggattaaatgattcaaccgcgttcggacgaaacatgagccggctgatcagaaaacgtttagaggcatatgacgaagcccctcttcatccccgattggggtggtacggaggaaaagacaatttagaatggaagcaatatttcctccgtgatgatgagacgcaagtgtcaaagtgtcccttttcttatttgaagagactgtttaaaccgacgaaataagctatgatccggcagggctgtgtccctgctttttttgtacgatccatgtcacgatcgcaatgacggcgagaaaacaaaggctgaccagaaaaccgggccggctcgatttctcaaacagcgtcccggagacggccgcgacaatcagcacaagggcgataacaatctgtacggttcccatctttgtcgtttcaagcagtttcttgcccgagaacaaaatgaacagccacgtataaagaagcatgaggcccgccgcggttgtcatgtgttcatatatgtttttcggcagcaccaatgacaggatgatggagacgatgagtccggcaaacgtcaatccgagcgcgggccagcagatttttttgttttcctttaatctgaagcatttcggcgcatctccgtcatctgccatcgtacaaagcaatgtcgtcacggcaaacagcgaggcgacgagcgtggaaaatcccgcaataataaaaatcccgttaaaaatatcaagaatgatatctaaatgaaaacccttcagcgatgtaataaacgggctgtcctgttcggtgaatttgcccagcggcactaacagcagcgccaggccgagagaaatgacgtaaatcaccgcaagaacggcaagcatcagccggcctgattttgaggcttcctccggctttttcaaatgcacggtcatcagccccaagacttcaattcctccgaaggcgtaaaacgcataaatcagtcccgtccatagccccatcgctccgtgcgggaacaaatcctttgattcgttcggcacctgcacatccggtttatgagaaaatataccgcacagcgccaatatggcgatcacgataaacataacaatcgccgccgtcttgacaacagcgagcacattttccgttttttgaaaaacggacagccccgtaaatataatcaaaagaccgagcaccgcatagatggaggcgaaaatccacagcggcacattcggaaaccaatgcttcgtaaaaagcgagatcgctgtcagctggcttcccgtgatcagcatctcggacgaccagtacacccatccgttgctgaaaccggcccaagtgccgaaagcctttctcgcatacgcgcaaaaagaccccttttcgggctgtttggccgagagcttcgcgagctgctcaaagacaaaataggtgccaagcccggcaataagaaatgagatcagcgcggaatatccgcttttgacaatagcgatgctggacccgagaaaaaagcccgtcccgattgtgcagccgacgccgattaaggagagctgccaccaagcgagattccctttaggctggtcctgtgatttactcatgaagttcaacccctttatcaaagcttagattgcggccgtcagaaggggaatatacatccaataaattgctttacatgaaacaaacggccggggttcataatagaagaaaaaaaggagcagtctgatgacacagcaatttatcgtaccgccgaaaaaagggctaggcctgaaggttcacaaagggcagattataaaagttgtcgatgtggaaggacagcaggtggctgattttacggcgtatcatgccaaggacttttatgaacatcttgatcagggcgcgacgatcgatgccaatcagtccattcatgtaaaaacgggtgatcatatttattcgaatttatacaagccgatgctgacgctgattgaggatacagtcggcaagcacgacttgctgcttcccgcctgccgtccggatatgaacaggcttttatacggaaagcataaagacgagctccaggatacgtgctatgacaatatgagcggggcgcttgaaccgttcggggtgccgcggccgcatatgcattacccatttgccatctttatgaacacggtgctcgatgagaaggggaacttatcagtcgaaacccctctttctgacgcgggtgattatgtacggctccgtgcggaaatggatctcgtcgtcgcgttttcatcctgtccgatcgaaaaaggaaaatgcaacggagacagcatcacggcgctgcgggtggaaatcagctgatcccggtgtatttgattcacttaaaatctgcacctgtgctatatttaacagagagtcgtacatagtggcatgattcattttcagcatgaacgggaaatggatcataaagaaacaatgcaggaggagtgattgggatgagcatccagaaacaaattatgaatgatctccatgtaaagccctcaattgatccgaaacaagaaattgaggacagagtgaactttctgaaacaatatttgaaaaaaacaggtgccaaaggctttgtgctcggcatcagcggggggcaggattccacgcttgcgggacgcctcgcccagttggcggctgaaagcatcagagaagaaggcggaaacgctgaatttatcgccgtccgccttccgcacggcacacagcaagatgaggatgacgcccaattggcgctcaaattcattaaacctgataaatcatggacatttgatattaagtccgctgtcagcgcgttcgctgatcagtataaaaaagacacgggcgatcagctgtctgactttaacaaaggaaatgtaaaagccagaatgagaatgatcgctcaatatgccatcggcggacaagaggggctgcttgtcatcggaaccgaccatgcggccgaggcggtgaccggtttcttcacgaaatacggtgacggcggagctgatctgctgccgctgaccggattaacgaaacgccagggcagacgtttattagaagaactcggcgcgccggaacgcctgtatttgaaattaccgacggccgatctgctcgatgaaaaaccgcagcagacggatgagaccgagctcggcatcacatacaatgacattgatgattatttagaaggcaaggatgtttcttccgaagtgattgaagcgctggaaaaacgctacctcagtacggagcacaagcgccaggtgccggcatcgatgtttgatgattggtggaaatagaatgaaaaaaacctcccttttgaaagggaggttttttgtttatttcatttttatttatctacactttcataaatccctacccaataccctttgctgctgtcatagtatttgtatttaaaaatccatgttgtaccattcagttcgaaagaagcagcgaaaataccgttagggcttggaacgggcttgatggcattaatgccggcatctgctttcgttgagattgggctattttccacggatggggatgctgttggtgatgcggcaaaggcaggagcggcagacatcagtaaggcaagagacagcgcagaaccggttaacacttttttgaatttcatttcgaacactcccttttcaaatgaaatgtattacagtgttaataattagacgattatccatataattccttctttatttctaaaatttttttcttaatttgaaaaaacaccccttcagaggggctttttatttattgatccatttgcatggatcagggacatgttttcaaaacgcttttttatttgatacggatatgattcagcttcaccattaatttgtcggtaaatcttcgaaggctgcctctcgaatcaggcttaagaggcagatttgcatgggcagcgatcgtttctgcggcctgctgaatagacatttggtctgtatggagatgttctgtgaagaggctatcagacaggctgttgatgcagcggtcgatttgttttgcggcccaggagttttttccttccgctctggtgcgcaggcgtttcagcaatgtttcctttgaagccagcagggtaaagtggtgaatggtccggccatcctgtctcagcctgctgataatgtcatggaagtattgatcgttcgtaatggtcatgggcacaatgatgatgccctgatatgtatctgacaaataggaaagcatgctgtaattgaattcccgccacagagggtagctttgaaagtcatcttcagcgatatccggcggtatcatcgaacgcatcgcaaaccccatcttttcaggatcatatacgtaagacggtttcagtcttctgtgcagttcaaacgctgtttgtgtttttccggaaccgaaagccccatttatccaaatgatcatcatgatatccccctttttctatatgatacaaaaaaaagacccttcgatcgaagagtcagcgggaaaaaacagacgtatattcccggagcgattcctttatatgcgtaaaggcatgttctccaaaatactcaagagaaacaaaaccgtcatattgtctgttcatcagctcttttaaaaatgctttttgatcgagatctccttggaaaatcggagttggcttgctgagataccagttgtcaaaattccagtgatagtttttcagatgaatatggctgacggtatgatacagcttttctaaagcggacatttggtcaacgtgattgacgtgtaggttggagccgtcaaaaatggtgcggacccgcggatgtccgacatcctccaaaaatgccagtgccgcctccggtgtatccgcgtacgtatcgtaatgaatctcaagcccgatatcgacttcatagtcatctgcgagccgtgctacctgctgaaattgatcaaccgcacgttgccacttttccggtgacgtccgatgcgaaggaagattgccggcaaagactctgatcaaggggctgtgcagctgtcgtgccgcgcttaatgccccttgaacatcctttaatgcctgtctttcatcctgagcggcgaagtcagtgtacaaactgacggcaggcaccccgaggccttcctcctgaagctgctgatcaagcctgtcgagcgggccgatttcctctatatattgtttagcgtgtccgtaccacagttcgattccgtcaaaggagtgctccttcgcgaaagaaatgatgtcgaaaatatgcttttttttaaatcctgtcgtgcaaaaactcagtttcatcggtaatcctcccgtaactgtctatcatatgtgtacttttccccgggtgagatacggataaacaggtgaaaagggcagacacttttataagcggagtgtcagtgcggcgcacaaattgtttagcgcttttttgcgtcaaagtattaaataattgaccgaagtgttgtacaattaatttcattcgagtaaggggggagaagccattgaaaaatgaaacggagctgacggacttcagtcccgtccgcaataaaccgactcgcgctcgttatgtgatactgtttcttttgttttttatcactgcgattaattatatagaccgtgccagtgtatccatcgccgccccgtccattcagacatcgctgaacataagccccgcgcttttgggcgtcgtcttttccgcattcagctggacctatacgggtatgcagattcccggcgggctcattttggacaaattcgggtcaaaacggacgtacggcgtttctttaatgatctggtctgttttcaccggagtgcaggcttttgcagccagtttcggatttttattcggctgccgcctgattatcgggctggctgaatcgcctgcgtttccggcaaacaatcggattgtcacgacatggtttccaaggcgggaacgcgcctttgccacgggtgtttatacggcgggggaatatgtgggactggcgttcgccacaccggttttattctgggtgttaacggcatttgactggcgcgccgtctttatttcctcaggggtgctcgggcttgttttctccgttttctggttcaaaatgtatcacgagccgaatcggtaccggaaagtgaaccgggaagagcttgattatattagagaaggcggcggactgacagaggtgtctgaatcagccggcaggatcacgtggcgggatttcgtccagcttcttaaataccgcaagcttgtcggcttgtatatcggccaattcgccgtagcctccacgctgttcttctttttgacatggtttccgacttatctggcggaggcaaagcacatggcattcttaaaagtcggcttcgccgcatcaatcccgtatatcgccgcctttttcggcgtattgttcggcggatattggtctgacggaatgatgaaacggggcgtgtcggtgaacgttgcccggaaaacccccgtcatcctcggtcttctgctgacaggctccatcgtgctcgcgaatgttacggattctgctcctgcggttttgacgatcttatccattgcttcttttgcgcagggcatgtccaatatatcctggacgatgctgagtgaggtggcgccaagcgaaacaatcggattggcaggaggcgtgtttaactttttcgccaatatggccggcattatcaccccgcttatcatcgggtttatcgtttctgcgaccggttcatataacggagcgattctgtttgtcggcgctgtcgcatttatcggggcattttcttatattttcattgtcggaaaggtggaacgcattacgctccgatagaaagaaaaactcatctcttcttataaaggatgggttttcttttattgcattatctctatatttcaatattgggttatcatataataaacataactttttcatttcttaggaggatttcgccgaagatgaacgcaaaacgtgccattcccgtaagagaaagaaacatcgtactgatcggattcatgggtgtcggaaagacaacaatcggccagctggtcgctaagaaattatacagagacttcattgatattgatttgcagattgagaaagatttcaatatgtccatccctgaaatgtttgagaaaaaaggtgaagcctttttccgtcaaactgaaaaggactatatattagatatctgccgcaatacgaaattcaagatcgtgtcgcttgggggcggttcgtttaaacaagaggcaatcagacagtgctgcctcgaaaactgtctcgtgctccatcttgatttatcatgggagaattggaagcagcgggctgacctgctgattgaaagccgtcccgttctgcataaccgttccatggatgaaatgcagcagctctttaacgagcgccaaagcatctatgataaacataattcaaaagtggcgacggataatctggaaccagaagaaatcgccgattatatcgtagaaacgttaaaaatcggctgggatctgtatcagccgatgtaaaaagagccgtgacgctgtgagcgtacggcttttttgttttcttttaaacaaacgtttattaaaatgtttagaaaatgagtgtaaaatcgtgttaagatagagtcagaaaattaaatcttataaaacaaaggagaataatcggatatgcaattatacgacttgccgctcgaccaactgcaaacctataaaccaaataaaaccgctcctcatgacttttcggatttttgggcatcatcattacatgagcttgcaaaggaagaggcaaagcctgaattgacggctgaaagctacccggctgacggcgtgaaagtattccggctgacataccgaagcttcggcaaggcggaaattgagggatggtacgccgttcccgaccggcaaggaccgcatccggccatcgtgaaatatcacggctacaacgcgagttatgacggagatatacatgacatcgtaaattgggcgcttcacggatatgccgcgttcggcatgcttgtccgcggccagcacagcagcacagatacaagcgtctcaccgcacggacacgttcccggctggatgacgaaagggattttagataaagatacatattattaccgcggcgtgtacttagacgccgtccgggctttggaagtcatcagcggctttgatgaagtggatgagacgagaatcgccgtcatcggggggagccagggaggcggactttcaatcgccgcggcggcactatctgacattccgagagcggttgcggccgattatccttatttaagcaattttgagcgggccattgatgtcgctcttgatgagccgtatcttgagattaactcttttttcagaaagaacggcagccctgagacggagaaggccgcgatgaatacactggcctattttgatatcatgaatctggcggaccgcgtaaaagttccggtgctcatgtctatcgggctgattgaccgcgtgactccgccgtcgacggtgtttgccgcttacaatcatctggaaacggaaaaagaattgaaggtttaccggtatttcggacatgaatacataccttctttccataaggaaaagctggcctttctgaaagcgcatctgaaaggctgacgacagcgaaaagcccaagtacttgggcttttttcaggaatgatcacggaaaaggacggatacagatggaacaaaggatcatcgaagaattaaaacgaattgaagcacagcacggcgtcaaggtgctttacgccgtagaatcagggagccgcgcatggggatttccgtcaagcgacagcgactacgatgtgcggtttctctatgtgccgaaaaaagaatggtacttttcgatcgaaccgcatagggatgtcatagaagagccgattcatgacatgcttgacatcagcggctgggaactgagaaaagcgctgcggctttttaaaaaatcaaatccgcctcttttggaatggctctcttctgagatgatctattatgaagctttctcagcggctgaaaagcttcgaaaactgaaaatccgcgccttttcgcctgaagccggcatttatcattatctcaatatggcaaaacggaatgaaaaaacggaattgcagggcagtgaagtgaagattaaaaagtatttttatgttttgcgtcctctccttgcctgcagatggattgaaacgttcggctccgtaccgccgatgtcatttcccgtactggccgatgccttattgacggatgaagcgctcatttctgaaatcaatacactgcttacaaggaaaaaaagcggtcaggagctggctccggaaccgagaaatatgatcattcacgcgtttatagaagaagaaatagaacgcatcgggcactatgtcaaaacgatcaaaacaccgaaacctgacataacggaggaactgaatcagctattgattcagaccgtcgaagaggcgtggggggaaaaaggcggaaattgacgattgccgtcatttccgtccgccttttttcggcataatccgcctgctatctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttatccaagagcagctttctcaataagatggcgcgaagctggggaagccgtgtggcagccggcaaaatcatcggaggaatggatttccgcagttctatcccgacaatccgacatttgaacagccaggggctgtcagttactgtcgatcatttgggggaatttgtcaacaacggtgacgttgcgaaagaacgcaccgaggagtgcatgcagaccatcgccttaattgctgatgaacagctgaattcccaagtgtcattaaaaatgacgtctttaggtcttgatatagatcttgatctcgtctatgaaaatatgacgaaaatcctccagacggctgaaaaacataaagtcatggtgacgattgacatggaagatgaaacgagatgccagaaaacgctggatatctttaaagacttccggagccggtatgaatatgtaagcaccgtggtgcaggcttatctgtacagaacggagaaggatcttgatgacctcagcccgctgaatccgtttctgcggcttgtcaaaggggcctataaagaatcggaaaaggtggcctatcctgaaaaaagcgacgtcgatgaaaattataaaagactcatccgcaaacagcttttaaaaggacattatacggcagttgccacgcatgatgacaaaatgatcgagtttacaaaacagcttgccgaagagcacggcattccaaacgaccgttttgagtttcagatgctgtacggcatgcgctcgcaaacccagctcagcctggtggaagaaggataccgtatgagagtctacctgccttacggggatgactggtacggctatttcatgagacggctcgccgagcgcccctcaaacatcgcattcgcctttaaaggaatgactaagaagtaaaaaagggagagatgacaatgactacaccttataaacacgaaccattcacgaatttccaagatcaatcgaacgttgaagaatttaagaaagcgcttgcgacggtaaatgagtatctgggaaaagattatccgctcgtcatcaacggtgaaaaggtagagacggaagcgaaaatcgtatccattaaccctgcagacaaagaagaagtcgtcggaaaagtgtcaaaggcgtcccaggagcacgctgagcaggcgattgaagcggctgcgaaagcgttcgaagagtggagatacacatcccctgaagaaagagctgccgttttgttccgcgcggctgccaaagtccgccgcagaaagcacgaattctccgccctgctcgtcaaggaagccggaaagccttggaatgaagctgatgcggatacggcggaagccatcgactttatggaatactacgcgcgccagatggttgaattggcaaaaggcaagccggtcaacagccgcgaaggcgagaagaaccaatatgtctacacaccgaccggcgtaacggtcgtcattccgccatggaacttcctctttgcgattatggcgggaacgacggtggcaccgatcgtaacgggcaacacggtcgttcttaaaccggcaagcgcgacaccggtcatcgcggcgaagttcgtagaagtgcttgaggaatcaggtcttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcgaaagtgcagccgggccagcagcacttaaagcgtgttatcgctgaaatgggcggtaaagatacggttgttgtcgatgaggacgcggacattgaattggcggctcaatccatctttacatcagcattcggcttcgctggacaaaaatgttctgcaggttcacgtgcagttgtccatgaaaaagtgtatgatcaagtattagagcgcgtcatcgaaatcactgaatcaaaagtgacggcaagccctgacagcgctgacgtgtatatgggacctgtcatcgaccaaggttcttacgacaagatcatgagctacattgaaatcggaaaagaagaaggccgtttagtaagcggcggcaccggagatgattcaaaaggctactttatcaagccgacgatcttcgctgaccttgatccgaaagccagactcatgcaggaagaaattttcgggccggtcgtggcgttttctaaagtatcaaactttgatgaagcactggaagtggccaacaatactgaatacggtttgacaggcgcggtcattacaaataaccgcaaacatattgaacgggcgaaacaggaattccatgtcggcaacctgtacttcaaccgcaattgtacgggagcgattgtcggctaccatccgttcggaggcttcaaaatgtccggcactgattcaaaagcgggcggcccggattatttggcccttcacatgcaggcgaaaacaatcagtgaaatgttttaagagggactgaatgggcatcctcctcgcggggggtgtccatttcaccataaacatataaagcggaggaggaaatgccatagcaaacattcagttgattatttccatttgtatttatatggcgggcatgctgtttatcggttattttgcctacagacggacgtcaaatctgacggattacatgctcggggggcgttctttaggccctgccgtcacagcgctcagcgcgggggcggcggatatgagcggatggctcttgatggggcttccgggcgccatgttctcaacgggattaagcggcgcttggattgtgatcggacttgtgctcggggcgtgggcgaactggcttttcgtcgcgccgagactgagaacgtataccgaaaaagcggggaattccatcaccattccgggtttccttgaaaaccgtttcggtgatcatacgaagcttctcagactgttttcgggtctcgtcattctcgtctttttcactttttacgtatcatccggcatggtgtccggaggtgtcttattcaacagcattttagggttgaattaccacacgggactgtgggtcgtgacaggcgtcgttgtcgcctacaccttgttcgggggctttttggcggtaagctggacggactttgttcaagggatcattatgtttgcggcgcttattcttgtgccgattgtgacgattttccatacgggcggcccgggggaaaccgttgccgatatccgttccgtcaacccggaactgtttaatatgttcaaagggacgaccgtcctcggcattatttctttatttgcgtgggggctcggctatttcgggcagccgcatattattgtgcgttttatggcgatcacatctgtgaaagagatcaaacgcgccagacggatcggaatgggatggatgattttgtctgcactcggcgcgctgtttacgggtcttgcgggaatcgcgtattaccaccagcgcgggttgaagctggctgatccggaaaccatttttattcagctcggcaacattctgttccacccgattattacgggatttctcatttctgcgattttagcggccattatgagtacgatttcgtctcagctgctcgttacgtccagttctttagtagaggatttgtataagtccatgttcaggcgttcagcttctgataaggaactcgtatttctggggagaatggcagtgcttgcggtgtcaatcatcgctttggtgctcgcctgggagaaaaacaacacgatacttggtcttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccagtctttcagactttttgtacgaaatcattccgggctttgctgtaagccttgccgctgtatttgttgtcagcttattgacacaggctccgtcaaaagatgtcacagatcagtttcatgactaccgtgatacactttctcaataaaagcaaggaacgagaggaagaagggaccgccctttttcctcttttcacgatacaggctttcggatcattccgttttgggagtatatgaatttttttctatacaaaaagtcacccctcagagtatgataaagataaaaagagcataggagaaataggtatggaagagcttttagagagagttttttcatttacggacattgataaattaattgatttcatcagttatgaattgcagaagcccgttattctggaaagcgcggatttctttttgcttgcctataattcttattacattaatcacttcgactccgccaaccagcagacgatattctcaaaaaaatgccccgtgcagatttttgaaaggtttctgaaggacggggtgatcgaaaagctgaaaaccgttcctgaaccgttccgtgtcgaaaaaatagacagtatcggattgaatcagagagtggttgtaagcgcaaaacataaaggggaagtgatgggctacatctggattcaggagctcgaccgaaacttgacggacgaggagctcgattttttatatgaaacttcattccatgtcggaaaaatcatctacaaaacgaaccggctgaaacaggaaaaagaagagagagcggaagacctggtgaaacgggcgatctttcagcaattctcctctgaaaaggagttcaggcgggaagcggaaaagatgaacgccgtgctgccgtcggttttttcggtagtcgtcctgcacgccgcaaatggggatggggaggcagtcgaagatgtaaaggaaaatatcaaatcgtacttgaatttgcgggataaagtcagccacgtcttaaccattgattccaatattgtcatcgtcgtcgcaagcttctcgcaaaaaagctccggcacttcggcagcatctgaattcatccacaaactgctgactcattttcactttcagaagatccccactcccatctatatcggaatcggcaatgaatacagcagcatcctgaagctcggcaaaagttatatagaagcccttgaagttataaaggccgccgaaattaccggaaaccaggaaaatatcccgtacgaatacagtaagctcgggatttaccgctatcttgaaagcatcgaagaaaaaaacgcctcactggaatatgtaaacgatgatttagcgttattaaaagccaaagacagagaaagcagcaccgaactgctgaaaacgttagaaatctatctcctcaataactgcaaaacaaaaccagccgcagaacagctttttattcatcaaaacacattgaactaccgcatcaaacagattcttgacatgacatcaattaatttaaacgacttcaggacaaggtgccagctgtatctcgatatcatgctgatgaaaaagagataaaaaagaaaccagtcgccgtactggtttcagttttaataccttcccgcttatcaatctcagaacctcacttctgaatcactcctttcccgcaagatgagaaatgaataaacactgctcctcaatatatgttatactttcattgatattgattctcaattaaaaaagtatgaagtatagatataaacgggaggcagaacgatggcggaaaatcatgaggtgtacgacgtcacgattataggcggaggcccgatcggcctgtttgcggctttttattgcgggatgcgggagctgaaaacgaaagtgatcgagtttttgccgcggctcgggggaaaggtgtctatgttttttcctgaaaaaatcatccgtgatatcggcggaatacccgggattgccggggaacagctgattaagcagctgaaggagcaggcggcgacatttgagccggatatcgtgttgaatcagcgggtggccggatttgaacggctggaagacggaaccattgtgctcgaaagttccgaaggggaaaagcactatacgcgcacggtgattttggccgtcggcatggggacgcttgaggtcaatgaacttgacagcgcggatgcgagccgttattcaggaaagaaccttcattataaggtggagaagcttgatgcgtttcgagataagcatgtcgtgatttccggagggggagataccgcggttgactgggcgaatgagctggaaccgattgcggcgtctgttaccgtcttgcaccgccgtgaggagtttggcggtttggaaagcagcgtggcgaaaatgaagcggtcttccgtgcgggtgcttgcgccgtatcgtctgaagcatctcaacggcaccggggaacggatcgagagcgtcaccgtttgccaaactgagtccggactttctgaagtcatcaagcttgatgagctcattatcaaccacgggtttaaaattgatctcggtccgatgaaggactgggggcttgagatagaagaaggcaggattaaagctgacaggcatatgcgcacgaatcttccgggcgtgtttgtcgccggtgacgccgcccattatgaaagcaagctcagactgattgccggcggtttcacggaggggccgaccgcagtgaacagcgccaaagcctatttggacccgcatgcggatcagatggcgatgtattcgactcatcataaaaaattggtgacacaataaaaaagggctgccccccgatgctgggtccgggggtcagaaaagcattccggcgtatcagctgtgaacgagcatgtctttcatttcatttcgtataaacgcaaataactgttcctgatttttcacggcggtaaacccgcagccggcggggaggtcttcgcccatgcagatgacgggagggcggtttcctctcgggttcggtgatatgccgatttgttttccggcgctgatcaaatgctgagcggattctttgcccgtacagataatcatttgcagaggtgactcactgatcgtgcgttcgatcatggaagtgaatcgctcatccgcgatatgttcatgggtgatataaaacaggcatgattttgagtctggcaagttttctgctgcttgacggctccctacaatgagagaatgcggagaatcattttgccattcggataggagaaagccccgttttgtcagttccgtctttgcggcttcagtcgctgcattcaggcttgcggtcacccggcggatgtcgatctgcttgaaagccagtgtgtcaaagaattcgcataccgcaaggcgtgatgtgaaaaatagttgttcaaaggtgctgatctgtttcaggatgttttcgtttgcgggcatttttttaacgatccgcttcggccattcaataacatcggcgccatactcgcgcagcttgtctgtcaatgtatgttcatcatccccatgagtgaccaccatgatatgccgtccgatgaacggtttgctttcaaaccagctgtgtgtttgaaaattgacaatatcaccgatgacgataatggcagggttggtgatgttttggctttgaactttttcatggatatcctgaagcgttcctttaacgctccgctgccgtccccacgtcccccattgaatgacgagtacgggaacggaaggggattttccgtactccataagcttcctgcatataaatgacagatttttaacgcccatgtaaaacacaagcgtttgaacgcttcgggcaagcccttcccagtcgagattcggcctgccgtgcaatgatgtatcatgagcggtgatcatcgcgaaggacgaagcgaaatcacgatgggtgacggggactcccgcatacagcggcgctgcaattcccgaggtgatgccgggcaccatttcgtagcggatgccgtgctgatgaagcgcctctgcctcttcgccgaccctgccgaacacacttggatctccgcctttcaagcggacgacggtgtagccctccgccgctttttctatcagcagggcatttatctcagactgtttcataaaatggcggtcgggcagctttccgcaataaatgaaccggcagtccggtgaggcgtattctagaaactttgggtttgcgagccggtcatacaaaatgatatccgctttctccagagcctgttttccttttacggtgatcagccccgggtctcctggtccggcaccgacaaagtatacgattccgtttttcatgatggcgtcatcccttcagcaatttaaaaaatgaaggaccacttggaaaagtgatccggtctttgatcaatacaggaggtatacattctctccttcgatcagtgtttcgtatgttttgacacagccatgatccggctcttggacttttccgtcttctaaggaaattttccagtcatgcatcgggcagaagacgtattctccgctgacgatgccttcagccaggacgccccctttatggggacagcggttttcgacggcgcggacgctcccgtcagaaagcttaaatacggcaagctctttatcttctatatatacggtttttcctaactcctcgggtaattcgtttacattgcctatgcaaacctttgtcatatctttattaaccatgtccgttcccccttactgttttatgaagtcgtgacgacattttcgaatagatctttagaagcttttttatctttaaggaagtattgccacggatctttgtggacagagagtgtctcattcattctgtcgttgagctcctgccgtctttccggatcgtttaatacggattggacatgagataaaccgacgcgctcaagccatgcggatgtccgctccagatagtttgccgtttctctgtagtactgaaggtaagcacccgcgtattctaagacttcttcattcgtttttactttcatcagcaaatcaccggcgcgcaaatgggttccgccgtttccgccgacataaagctcccagcctccgtcgatgccgacaacgccaaggtccttaatgcctgattccgcacagttccgcgggcaggcggacacggccattttaaccttatgaggcgtattgagcccttcgaattttttctcaagcgcaatacccagtgccatggagtcttgtgtgccgaagcggcagaattgttcgcctacgcacgtttttaccgtgcggagtgtttttccgtacgcgtagcctgacggcatatcaagctcggcccatactttcggcagatcttcttttttaacgccgatgagatcaattcgctggccgccggtcattttaacgagcgggatctcatatttgtcgacgacatcggcgatcttgcggagatcttgagagttggttacgcccccgtacatccggggaacgactgagtatgttccgtctttttgaatattggcgtgcatccgttcgttcacaaaacgggatgttctgtcatcctcgtatgcagccggattaatcatgcctaagtagtagttgagggcaggccggcatttggagcagccttccggcgttttccagccgagcacgttcatgatttctctcgtatgtgagagccctttggctttgatttcttctacgacttcatctctcgacagtgaggtacagccgcaaatcgcttctttttgcgcggatgagtcaaattctgatcccagtgtatattgaagaatgtcttctacgagcggtttacagcctccgcaggaacgggatgccccggtgcatgctttgatttcgtccgttgatgtgcagcctttttcctgaatggcttgaataatcgcaccttttgaaacgccgttgcagccgcagatgatttcatcgtcgctcatcgccgcggtcatgcttgcgcctgcttcctgatcaagaggctgtaagattgatattttggaggtttcagagatatctgcttctttttgaatcatagaaaacaggcggttgccttcgctgctgtctccgaacaaaacagcgccgacaatttgattgcccctcaggacgatttttttataaatgccgtcctgttcatcgaacacttttattgcctttttgtcctctgattcatcaaagtcgccggcagagaagacctcgacgcctgatacctttaattgagtggagagaacggagccttcgtacggttttgtttcaatgccgcaaatatgtttggccagcacttttgcctgttcatagagcggcgccacaagaccgtacgcgattccgcggtgctcggcacattcaccgaccgcgtaaatgtgcggaatttcagtctgcatataatcgttgacaatgattccgcggtttaccgggatgccgctttctgtgccaagctgtgtattcgggcggatgccgaccgccatgacgaccagatcagcttcgatgcttgtgccgtctttaaagcgtacgccttcgacacggtcagtaccgagaatttcttcggtttgtttttcaaggaaaaatgtcatgccttgtttttctaactcgttttgcagcaggcgtcccgccgctgcgtcaagctggcgctccatcaggaatggggcgaggtggatgacagacacgtccatgccgagattcagcagtccgcgcgcggcttccaaacccagcagtcctccgccgatgacggctgcttttttatattgttttgacgcggcgagcatcgtgtcggtatcttttatgtcccggaatgccgtgacgccttgtttgtctgcgcccggaatcggaaggataaaagggacagagcctgtcgccaggatgagttcatcgtaaggctggattctgtctgcatcggtgatgacggtttggttttccgtgtcgactttgatgactgtttcaccggtatacagctgaatgttgttttctttgtaccagttccgatcgtttaacgtaatgtcttgaatgtcggtatcgccttgcagcacttttgacagaaggattcggttatagttgggatgaggttcggccccgaatattgtaatctcaaattcgtcttttgaaacacgcagtatttcttcaatcgctcttaccccggccattccatttccaacaaggactagctgtttttttcccatcagatgatccgctccttatctttgtttttttcagcgtagcacagcaaaaacaaatatttaagatgcatgttatgaaatgtaacaaaaaatacgaaaaaatctaaaaattttatgaaaattagatagggctgattcgtaccgcacacatcttaaaaccgggcattttacagtccggatccaaggcttcaccaattaaatcgttgacgttttgcgtgtcagaccaatggatggggacaaacaacgtgtgatgtgtctgacttttacttgattttaaacggagaatacatcaaaataaatagtaacgattacgatttaaaactatgtacatcatgatgaaaataaggcagttgcgagatataaatcgtaatcattctattttgtcagggggctattgatatgaaaaaaattccggttacagtattgagcggctatcttggtgccggaaagacgaccgttttgaatcatattttacaaaaccgcaacggtttaaaaattgccgtcatcgtcaatgacatgagcgaagtaaatatagacgcgggcttggtgaagcagggaggcggtttgtcaaggacggatgagaaactagtagaattatccaacggctgtatctgctgcacgctgcgtgaagatttattagtcgaagttgagaaactcgcgaaagacggcaggtttgattatattgtcattgaatcaacagggatcagcgaaccgattcccgttgcccagacattttcttatatagatgaagaaatgggcattgatctgacaacattctgcaggctggacacaatggtgaccgtggtggatgcaaaccgcttctggcatgatttccagtccggtgacagccttcttgaccggaaggaagcggcgggagaagaggatgaacgggagattgccgatttattaattgaccaaatcgagttttgtgatgtgctcattttaaataaatgcgacatggtgggcgaaaaagagcttgaacagctggaaacggttcttcgcgcattacagccccgtgccagactgatccggtccgtccgcggagaagtgcccgccgaatgcatattgaataccggtttatttgagtttgaggaagcgagttcatcagcaggatggataaaggaactgacggcaggtcatgaagcgcacactccggaaacggaagagtacggcatcacttcgtttgtgtactcgcggcgtctgccgtttcataccgttcgttttgacagctggctgcatcaatcaatgcctgacaacattgtgcgcgcaaaaggaattgtttggtgcgcaacccgcaacagccttgcgctgctgatgtctcaggcgggtccggcggtttcggttgagcctgtttcttattgggtggcggcaatgccgaaacttgagcaggagcagatcaaaaagcaggaaccggagattctggaagattgggacgaccaattcggagatcgtcatacgaacttggtgtttatcggaacagatttagatgaagccgccattacaaaggaattggatcagtgcctgctcacgccgtctgagttcgattccgactggtcgcagcttgaagatccttttcaatgggatattcagcgggccgaataacataccggccaagtttagaagcaggtgaaaagggaaggagtgatgaaaaaggagctgaccaagtgtgaaagcattgacataccaaggaaaagaacatatggaagtgaaagaagtcccggcacccgccattcaagatgagagagatgtcatcgttcgaatcaccgcaaccgggatatgcggttcagaccttcatttatataaaaacggaatacccgccgatccgggttatattgtcgggcatgagccgatgggaattgtggaagaaacgggcagtcaagtcaaaaagctgaaaaaaggcgaccgggtcgtgattccttttaacatcggctgcggagaatgtcattactgcaagcatcagatggaaagccagtgtgatgaatcaaatccaaatcctcatacagatgccggcggtttattcggtttttcggagtttaacggaaattaccccggcgggcaggctgaatatttacgtgttccttatgctgatttctcttcttttctggttccggcagacagtgagcttgaagatgagcaggtgctgcttctgtcagatgtcatgccgaccgccttttggagcgttcagcacagcggagtgaaaaaaggagatacagtcgttattctgggatcaggtccgatcggcttaatggcgcaaaaattcgcgtggaaaaaaggagctaaacgggttatcgcagttgatcaagtcccgcaccgccttgaacatgcgagacgcataaacggagcagagaccttcaatttttcagaacatgatgagatcgggaaactgctgcatgaacaaacgtcagggggcgcggatgtagtgattgattgtgtcggaatggacggcacgccgctttcaaaagaaaaagcagagcaaaaaccgaatcagttcggaacgatcagcccgattcttacagcatcagaagccgttaagaagttcggaaccgtgcagctcacgggcgcatacatttctgaagcggacggctttccgctcggcgattttttcacacgcaacgtttctttaaaaatgggccaggcacccgttattcatctgatgccgatgctgtatcaaatgattgaacaaaatgaaattgatccgacggatatcattacacacaaaatgagtcttgcggaagctcctgctgcatatgatatatttgacaaaaaagaagatggcaacattaaagtgattttgaagccatagcgaggggaaacatgatgaatatttacagaccggcgggattttggatcagattgggagccgttgtactcgactatttaattacttcagtgcctttggcgattatttttatgctggcaacaggaaaagacccgaatgagagcgcaatgatcagcatcattttgactctttatggaattttgctccctgtatactggaacggctatgttatcggcaaaaagatctgcggtatccgcatcgtcaaaaaagacggaaaccaggcaggctttcttactatgattttgagagtgcttgtgggcggcctgatatatggcgtgacgtttggaatcggtgtgatcgtgagcgcattcatggtcggaatgagagaagacaaacggtcaatccacgattttgtagcgggaacgtatgtcacatacgcactgccggacgaatcgattgaaaagagcgaataatttcgctctttttttgcataaaaaatggatgagggagcaacatataacaaacgttaaaggaggaaagagtcatgaaaaaagctgcattgtctttagctgcgtttttcattacagcaatggttttcacaatgccggcacacgccgaaacaaaaatgccttcaacaatgtcactcacggaacagcagaaaaaagaaattgaatcacttgaaaaagaagtgctcgaaaaacgcaaacatgtcatatccaaatatgttgagtacggggtcctgccgaaagaaaaagcagaacatattaaacagcatatggacaggcgctttaatatgatgaaacaaaatggctttgtcccgaagcctccgcctcataaattggaaaagcggcatcatcattcttaagcatccggcaagccggatgcttttttgtttttatcgggattgctctgaaatgcgtttcaaaacgtatgatatcaatatcatacgcatcaggaggatgaaacacatgatacataaaaaacagggtctgttccctgatacatttctatgggggtcagcttcggctgcctatcaggttgaaggagcttggaataagacggtaaaggaccttcagtatgggtgaactgtgcagagaggctattagtgacggagttcatctcatcggctgctgcagctggtcattcacggatctgtttaagctggctgaacggctatcaaaaacgctacggttttgtgtatatcaatcgagatgaagaagatgaaaaagacttgaaacggatcaggaaaacagtttttattggtaccagaatgtaattgaaacaaacggtaaaagtttataaaagttccctgagagaaatatgattctctcaggggtttcttttacattgcgtctgcatcaataatatacgtatccgcatgaagatcggatatttcggcaggcactgaataacaggtaaggctgtatcggcctttcggaatattaaagaaaagccgctttgacatcacgctttcaatctcaattccatcttttacagcctcaaagggaacagtcgcttttttctcataggatagtaccggttcacttgtgttaagcctgaagacgataaatgccctcgtatttctccttgcttcgaatgaaacagctccgtcagcttccgcatatcctttttcaatggcttcatcggtccaatcgataacaggcggttctgaatctttttggaagattgtaaattgatgatacgaaatggccagttcttgcggtttccatgatttattcaatgcgctgttcctcctgtttttttacttgattttaaataatactctcgttccgtcgggatcattggtaagctggtgtccgacccaagagccggctccgcggttgtctgccggagaaatatattctacggaggcattgtttccgccctgtttacaaaccgccatcggccattcatccctatcgtatcccgttttgacaggcacatgtttaagagattgctcacgccgcttatgtactccgtctctgtcaatggtgcatatgctggaatgcccttcttttatcgcgtccttaatatgctttgctgtttccggatatcgatcggacggaaataggattactttgtcgtaatcactcttctgaacggtctgctcgttatctgagaaaagatcacccttgatcagggccgcgactgctccggcaatgatgataagaacaagcagcagtgcttttaatgttttcaagagtatcaatcacctccagttttaaattgctgtaaagctggtccaagaataaagcagaatcggccggctgtaaagctgttaaaatatatttctcagccgcaattcagctgaatatctgtaaaaccatccgcacaaatcaattttattcattaaatatccgatcagaaagtgttttttgccgtttccctattcagaaatgaacggttgcggccgtatcgtcaattgacttattatagcgataagctcaccggcaggatatcttcgtctgcgagtgtccgacccgaaaaccttggcctgcatgaccgtgcgcaacaagacgataaaaagacggccatctgataagaaggccgtcagtaaatcattccagattcgcatgctttgtaaacatgtctgctgaattcagttcttttttctccatgatttttagaataaccgcatcgtaaaacagcagaagagtttgttcgaataaagaacccatcggctgaatcgtctttctgtctccgccggtctcttccttaggagagccgggaatcgttatcgtaagatccgcaagtttgccgagacttgaatcggggttaatcgttaatgcagtgatgatgccgttaaggcttttggctttttcagctgtatgaagcagactttttgtttcgcctgagcctgagccgatgatgacgagaccgccttcttggaggggaggggtaagcgtctcaccgacgatgtaagcgttcaggccgatgtgcatcatcctcatggcgaacgctttagccataaagccggaacgccccgctccggacgtgaagatttgatctgccgataaaatctcatctgcaagcttgtcagcttcactgtcggctattaatgctgcggtgcgggatatttcattgagtatttcatgtaagtattcagtcgttttcatgatccttgtgaaatcagctgtttcattttagcagcagcatccgctttattgtcagctcccgtaatgcctccgccgacaatgattaaatctgggttttgtttgatggcttcaggaagcgtatcaagtttaatgcctccggcaattgcggttttagcgctcttgaccgcttttttaatcgccgtcagttcctcgaatgaattctttccttctgcttgaagatcataacctgtgtgaacacaaatataatcaacaccgagttggtcaatttcttttgcccgtgtttcaaggttttttacgttaatcatgtcgacgagaatttttttctgctgtttttttgcttcggcaaccgcccctttgatcgttgagtcgtctgtcgctcctaaaacggtgatgatgtcggcgcccgcttctgccgctttcatgatctcgtagccgcctgcatccatgattttaagatcggcaagcactttcaggtgaggaaaggctgatttcatttcctgtacggctttcaggccttcattaatgacaacgggagtgccgatttctacaacatctatatattgttcgacctctttcacaagttcaattgcttccgggatattcactaagtctaatgccagctgtaattccactttatatccactcctctttttcatgtatttacattctatagagtgccccgcatgttgagaagtacgcactttgaagtctaatagttactttgaggatactgtccccgcaggcaatgcgctttgtttcagcaaaactgcgtggtagtataaactgatgaaagttgtgtaaaaaagtaagcgtgtatgaatagatgatgaacgtacaaaaagtaagaggaaggagaatggcccgtgagccgaatggatgagaaaacgtttaattgcgaaaaggaattgacgcttgccgtgataggcgggaagtggaaaatgctgattatgtggcacctgggaaaagaaggaacaaagcggtttaatgagctgaaagctttaattccggatattacgcacaaaattcttgtgaatcagctcagggagctggagcaggatctgatcgttcacagggaagtttaccctgtcgtccctccgaaagtggagtactcattaacggagcaaggagagacccttatgccgattttggacgccatgtataagtggggaaaagaatatatggaattaatcaacattgataaaactgcaataaaggaatctttttgaagcgctctatgtaaaatagagtgctttttttgcggtttaatgaaatcatattgcgaacgattaaatctcctgtttcggttcttgcgctgttttttccccatcagctcatatatgaaaactattttcattctgccataactggatattcgagagatttatactatagtttaaagatttttaattttacataaataatatttttaaaaataaattgcgggatgccgcaaaataccctctggaattgtcggaatttttttcggtgtgccgaatgaaacttttcacccatttttcggtgataaaaacaataatttcatataaagtgaacgtaagtagatatatagtaattcatgaagaaataggtaaaccctgttgcttacaaacattggattcttgtcttgatttctcataaatttgagccgcatttcggactgtgcgggtgagtggattgcggatttcggcggtgattgaatcgggatcgttttggaggtaagtggttcttttggcttgataatgagttagggacattgagggaggctgtttctaagggagaattgacaattttatcttaaaaaggggaggcgcacacatatggaaataactttttatcctttaacaaatgctcaaaaacgtatctggtatacagaaaaattctatccgaacacaagtatttcaaatcttgccgggttcgggaaactcatttctgacgacggcgtacaggctcattacgttgagaaagcgatacaggaattcgtccggcggtatgagtcgatgagaatccgtctgcggcttgatgatgagggggagcccgttcaatatgtgagcgattaccgtccgctgactatcgaacatacagacatcaggcaagccggctgctctgcggaagagctgtcaaaatggggacgtgacgaggcaagcaagcctctggcattatatgatcaggatttattccgtttttccgtgtataccatcagcgaaaatgaggtctggttttacgttaatgtgcatcacattatttcagacgggatttccatgacgattctgggcaatgcgattactgatatttatttggagctttcgggcggagcaagtatggaacagacggagattccttcctttatcgagcatgtgctgactgagcaggaatatgtgcagtcgaagcggtttaaaaaggatcgggatttttggaacgggcagttcgagaccgtgccggagcttgtgtccctgaaacggagccaggcagatgcgggtcttgatgcgaaacggttttctcaagaaattcctcacgacttatatggccgcattcattcattctgcgaggagcataaagtcagcgtactatctctgttccaatcagctttgatcacttatctctacaaagtgaccggccgggatgacgttgttacgggtacgtttatgggaaaccggacaaatgcgaaagaaaagcagatgctcgggatgttcgtatctacggttcctgtgcggacaagcgttgacggaggacagtcgttcttggaattcgttaaaggccggatgaaggatctgatgaaaattctccgccaccaaaagtatccgtataacctgcttgtcaatgatttgcgcgcttcgaaaagttcgctgagcagattgtttacggtggctctggagtaccaggtgatgcagtggcagaaaaaagagaatctgtccttcctgacagaccctattttcagcggaagcggtacaaatgatatttcgattcatgtgaaggaacgatgggacactgggaaattgacgattgattttgactatcgcagcgacatattcaagggagaggagattgtatctgtttctgaacgtttgatcacgctgattgaagatgcgatttcatctcctgatcgcataattgatgagcttactcttctttctgaatccgagaaagagcggctgttgacacgggcctcaggcaatccggtgaattaccgcggggagatgacgataccggggctgtttgaagagaaagtgaagtcactgtctgacaaaccggcggtggtgtatgaaggccgaacattgtcctatcgcacattgcatgaacagtcaggccgaattgccggacgtcttcttaatgccgggatatcagccgattctcctgtcgcggtgctgcttggccgttctgagcgtgttattgcggcaatattgggaattttgaaagcgggcggcgcctatgtgccgatagatcctgactttccggcggatcggattcagtacattttggaggacagcggagcgaaggctgttctgacagaggccggaatacaggcgcctgcagcggatgccgaacggattgattttgacgaggctgttcagtttgaaacggctgcggacggtgtcagtacacaatcagaccggctggcttacatcatctacacgtcaggtacaacggggcggccgaaaggcgtgatgattgagcaccggcaagttcatcatctggtgcaatcactgcagcaggagatttatcaatgcggtgagcagacattaagaatggcgcttttggctccgtttcattttgatgcgtccgtcaaacagatttttgcctcgcttcttttgggacagacgctttatatcgtgccgaaaacgactgtaacgaatggctcggcactgctggactattatcgtcaaaaccggattgaagccactgacggaacccctgcgcatctgcagatgatggttgcggcgggagatgtcagcggaattgaattgcgccacatgctcattgggggagagggcctgtccgccgctgttgctgaacagctgatgaacctctttcatcaatcgggcagggcgccgcgtctgacgaatgtctacgggccgacagaaacgtgcgtagatgcgtccgtgcatcaggtgtcagccgataacggaatgaatcaacaggcggcgtacgttccgatcggaaaaccgctcggcaacgcccgtctgtatatattggataagcaccagaggcttcagcccgacgggacggccggtgagctgtatatcgcgggtgacggtgtaggccgcggctatttaaatcttccggatttgaccgcagagaagtttttgcaagatccgtttaacggaagcggccgcatgtaccgcacgggtgatatggcgcgctggctgccggacgggacgatcgaatatatcggccgtgaagatgatcaggtgaaagtccgcggctaccgtattgagctgggagaaattgaaacggtgctcagaaaagctccgggggcggcgcaggccgtcgtgctggcacggccggatcagcagggcagcttagatgtttgcgcatatatcgttcaggaaaaaggagccgagtttcaccctgccgagtacagggagtatgtgtccaagcaccttcctgattacatggtgcccgcttactttacaaaaacggacgaaattccgctcacgccgagcgggaaggcggaccgcaaaaagctgtttgcgcttgatgtgcaggctgtcagctcatccgaatatgccgcgccgagaaacgaaacggaggaaacgctcaccgtcatctggcaggaagtcctcggaatggacaaggcgggcatttatgatcatttcttcgagtcaggcggtcattcattaaaggcaatgacgcttctgacgaaaattcataagcaaatgggcgttgaaattccgctgcaatacttgtttgagcatccgacgattgcggcgcttgccgattatgcggaaaaccgaaacgaaggaccggcattcagggcgattgagccggctgagaagcaggcgagctatccgctttcgctcgctcagcagcggacttatatcgcgagccaatttgaagatgcgggagtcggatataacatgccggctgcggccgtgattgagggcgctttagaccttgaaaagctcgagcgtgcattttctgccttaatcagcaggcatgaagcgctcagaacatcgtttcaatcggaggacggcacgccgagacaggtggttcacgaacatgttccgtttcatattgaaatgatcgaagcgcgcggaagaacgaatgaacaggtcatgaaggactttgtgcgccgttttgatttatctgaggcgccgctgttcagaatcggcctgcaaacgctaggtcacaatcgccatatgctgctgtttgatatgcatcacctgatttctgacggggtgtctatttccatcatgctgaaggaactggctgacatctacggcggaaatcagctgcctgaattgcgcattcaatataaagattatgccgtatggcaggcggaacgggcgaaagaaggctacaagaaggagcgggcgtactggaaagaagtcttcagcggcgaactgccggtgcttcagctgctccctgattatccgcggccgcaggtgcaaagctttgaaggtgaccgcgtgtccgtcaagctgccgaaaatgctgcgggaacggctgcagaagcttgccgagaaaaacggagccactctttacatggtgctgttatcggcatactatacgctgctttctaagtattcgggacaggaagacatcatcgtgggaacaccgtcagcgggaagaaatcactctgataccgaggggcttatcgggatgtttgtcaacacgcttgcgctgcgaagctccgtgaagcaggatcagacatttgccggcttgttaggtcatgtgcgcaaacaggtgctggacgcgttttcccatcaggattatccgtttgagtggctgaccgaggagctgaacgtgccccgggacatgagcaggcatccgatatttgacacgatgttcagtctgcaaaatgcttcggacggaattccggagatcggcaacctgacgctgtctcttcatgaaaccaacttcaatatcgccaaattcgatctgacaatgcaggcccgggaaacagcggaaggcattgcgctcgatttggattattgcacgaagctgtttaagcgctcaactgcggatcgcatgcttgcgcactatgtccgtctgctggagaacgcggcagctcatccggatgcgaaaatcagcgaatatgatctgctttctgaacgggaggctttgaaccaattacagcggttcaatccggagcgcacggcatacccgaaagagcaaacgatcgtgcagatctttgaagaacaggcccgaaagaaccctgaccggacagctcttcagttcgaaggggatactctgtcgtatcagcagctgaatgaacgcgccaacaggcttgcgcggcatattctttcggtcggaggcggcggggaaaccgcggctgttttatgtgaacggtcaatggacatgattgtttccattatggctgtgttaaaagcggggtccgcctatgtgccgattgatcctgagcatccggttcagcggattcagcatttcttccgcgacagcggggcgaatgtgctcctgactcagcaaagcctcaagccgcttgcggaaaaggccggttttcaaggcgtcattgtgcttgctgatgatgaggcgagctatgaaaaggactctcgcaatccagcattgccgtttgattccaaaacgattgccaatctcacgtatacatcaggcacgacgggaacgccgaaaggaaacatcgtcacacatgccaacattttgcggacggtaaaaaacacgaactatttgaccgtttctgaagaggacacagtgctcggtctgtcaaactacgtctttgacgcttttatgtttgatatgttcggttcgctgttaaacggtgcaaagcttgtgatcgtcccgaaagatacggtgctggacatgtcgcgcctgtcccgtgtgatcaaacgggagaacgtcagcattctgatgattacgacggccctgttccacctgcttgttgatatggagccgtcctgtctgacgacgcttcggaaaatcatgttcgggggcgaaagagcgtctgtagaacatgtcaaaaaggcgctggcggcagtcgggaaaggaagactgcttcatatgtacggtccgtcggaaagcacggtgtttgcgacataccatccggtggatgtcattgaagaggatacgctctccgttccgatcggtaaaccggtcagcaatacggaagtctttattatgaactcagccggacgcattcagccggcgggtatcgcgggagagctgtgcgtcagcggggaaggtctcgtagaaggctactacaaccgtcctgaactgacggaagaaaaatttgtaaagcatccgtttaaggaaggtgaacggatgtataaaacgggcgacttggccagatggcttccgaatggcgatatcgagtttatcggacgcatcgaccatcaggtgaaaatccgcggtcagcggattgagcttggcgaaattgagcatcagcttcaaagccatgatcagattcaggaatgcatagtgctcgctgtggatcagggcgcgggtgacaaacttctttgcgcgtattttgtcggcctcagggaaatatcttcccgggagctgagggagcatacggcgaaggatcttccggcttatatgattccgtccgtctttattcaattggatgaactgcctcttacagggaacggaaaaatcgacaggcgggcgctgccgatgccggatgtgaccgcagcgaatgccgtgtcatatacggcgccgcgcaatgaaacagaaaaaaaactggcggatatttgggctgaggtgctgcaaatggaacgggtcggcgtccatgatcagttctttgagatcgggggccactcgttagcggggatgaaactgctggcccttatccagaagacattcggcgtgcagcttaccttaaaggacctgttcacttctccgacggctgctgggctggcgcagctgattgaaggggctgagcggaaggcggctgagagcatcgcaccggctgcggagcgggaaacgtatccggtttcttcaccgcagaagcggatgttcgtgcttcagcagctggaaggcgctgaaacaagctataacatgccgtctgtgctccgtttaaaaggaaagcttgatgcagaaaagctgaaatccgtcatgaaacagctgacagaacgccatgaagccttcagaacgacatttgacataaaggatggagaaacggttcagcgtatatgggcggaagcttatatcgacatggaatattatgaagcctctgaagaagatgctgaacagattattcagagctttatccggccgttccgtctggatcagcttcctctcgtcagaacggggctggtcaagctggctgaacatgaccacctgctgctgtttgatatgcaccatatcatttcggacggcgcttcagtcggcgtgctgatagatgaactgtcccgcttgtatggcggcgaaacgcttgagccgctgcggattcattataaagactatgcggtatggcagcagaaatttattcaatcagagcagtaccgcaagcaggaggagcattggcttcgggagcttgacggcgagcttccggtattgacgctgccggctgattacagccgtccggccgtgcaaacctttgaaggagacaagctggtcttttctctgactgaggaacagacgtcggctcttcgcagtcttgcgaaacaaacggattctaccatgtacatggtgctcctggcgtcgtacagcgcctttctctcaaaactgagcggacagcatgacatcattgtcggctcgccggttgcgggacggtcacatgcggatctcgcaaacgtcatcggtgtttttgtgaatacactcgcgctgcgtacgtatccggaagcggacaaaacgttcacggactatcttaaagaagtgaaacaaaccgctttacatgcatttgacgcgcaggattatccgcttgaagaccttctgcaaaaggttgaggtgcagcgtgatacgagccgaaatccgctgtttgatgcggtattctcaatgcaaaatgcaaatgctgaagatctggtcatggaaggaattgagctgaagcaccacccgtttgacagaaaaacagccaagtttgacctgacggtgacggctgaggacacagacgaaggcttaacgtttgtgcttgaatataacaccgcgctgtttaaaccggaaacggcagagacgtggaagcattattggcttcaactgttaaaagccgcaacggaaaatccggctgcgaagctttctgagctttccttggtgaatgaaacagaaaaacaagccctcctcaatgcatggaaaggaaaaacaatttctgtgccgcaggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtgccggatggctacacaggagatacgattctgcttgacggcggacgctccattctgagcctgccgcttgatgaaaacgatgaagcgaacccgcagacggaaacaacggcggatcatctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggcttcggttttgacgcctccatctgggagatgttcccgacatggaccatcggcgcggaacttcacgtcattgacgaagcgatccggctggatatcacccgcttaaatcactatttcgaagagcacggcgtaaccatcaccttcctgccgacgcagctggccgaacaatttatggagctggaaaatacctctctccgcatgcttctcgtcggcggcgacaagctgaaacgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggcgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcgggcgtattgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgcttccggactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttccgacatttgggaggaagtgctcggtcttgatcagatcggcgtaagcgataatttcttcaccctcggcggcgactcgatcaaaggcatccaaatggcgagccgcctgaaccagcacggctacaagctggagatgaaagacctcttccagcacccgaccatcgaagagctcgtctcttatgtggagcggacggaaggcaagcaggccgaccagggacctgtcgaaggcgaagcggagttaacgccgatccagcgctggttctttgagaaaaacttcacggacaaacaccactggaaccaatccgtcatgcttcatgcgaaagacggctttgatccggagataacagaaaaaacattacatgtcctgacggtgcaccatgatgcgctccggatgatttatcgtgaacaaaaaccgtattacagagggcttgaggatgcgtctgttgaactgaacgtctttgagctgaacggacctgctgaagatcatgaggaccgtatcgaacgggaagcagaccgtcttcaaagcagtatttcactggaaacaggacatctgctgaaggccgggctcttccgggctgaagatggagaccaccttcttctcgcaatccatcacttagtcgtggatggtgtatcttggcggattttactggaggacttcacgtccgtttatacgcagctgaaacaaggcaatgaaccggcgctgcctccgaaaacacattcattcgccgaatttgctgagagaatcaaagaatacgcaaatacgaaggcgtttctgaaagaagcggattactggagggggcttgaggagaaagaggtatgcactcagcttccgaaagacaggcagtctggcgatcagcgcatgagacatacgagaacggtcagtttctctctgacgcctgaacaaactgaacagctgacgacaaacgtacatgaagcctaccatacggaaatgaacgacatcctgctcacggcgctcggactggcgctgaaagagtggacgggtgaagacacgatcggcgttcatttggaaggccacgggcgcgaagacattcttgacggcctgaatatcacccggacggtcggatggtttacgagcatgtatccgatgatccttgagatgaagcacgccgacgatctttcatatcagctgaaacaaatgaaagaagacatcagacacatcccgaacaaaggagtcggctacggcattctgcgttatgtaacggcgcctgagcataaagagggtctttcatttgagattgatccggatatcagctttaactacttaggccagtttaatgagatgtcggattccggcttatttacaagatccgggatgccgtcaggacaatcgctgagccctgacacagagaagccgaatgcgcttgatattgtcggatttatagaaaatgggcagatgacgatgacgtttgcctatcattctctcgaatttcatgaaaaaaccattcaatcgttcagtgacagctttaaagggcacctcttgaaaatcatagatcactgcctggcccaagacggacctgagcttacgcctagcgatcttggcgatgatgatctgacgcttgatgaacttgataaattaatggaaattctctaacagaaaagacagaggtgacatatgagcaaaaaatcgattcaaaaggtgtatgcactcacaccgatgcaggagggaatgctgtatcatgcgctgcttgatccgcattcttcctcctacttcacacaattagagcttaggattcacggaagctttcagcttgagctttttgaaaaaagtgtcaatgagctgattcggacatatgacatcctgcgtacggtattcgtgcaccagcagcttcaaaaaccgcgccaagtcgtattagcagagcggaagacgaaggtgcactatgaagatatcagtcaattagatgaagcgcgccaaaccgaatatattgaacgctataaacgcgatgtgcagcagcagggctttcatctggcgaaggatattctctttaaagcggcggtgttcaggctcagtgagaaggaactgtatctcgtctggagcaatcatcatatcgtcatggacggctggagtatgggcgttttgatgaaaagcctgtttcaaaactatgaagcgcttcgtgccggccggcccgccgggggaagccagggcaaaccttactctgactatatcaaatggctcggaggcagggattatgaggaggcggaacaatattggagcagccgcctggcggatttcgaacagccgagcctgctcccgggccgtctggcatcagaaaagaaagactaccaaaatgaagaatattcttttgtctgggatgaagagctggtcgcgcagattcagcagaccgccaaccggcatcaagtcacggggcctaacctgtttcaggccgtttggggtgcggtgctcagcaaatacaactatacagacgatgtggtgttcggcaccgtcgtatcaggccgtccttcagaaatcaacggcattgaaacgatggcggggctgttcatcaatacgattcccgtcagaatcaagattgacaaagatgcagccttttctgacgtgatggcggcagttcagaaaaacgccgtggaagccgagcgctatgattatgtgccgctctatgacattcaaaagcgctccgctctggacggcagcctcttgaatcatttggtcgcgtttgaaaactatccgctggacaaagagctggaaaacgggggcatggaggaaagactcggtttttccattaaagttgaacatgcttttgagcagacgagctttgatttcaatctcatcgtgtatccgggaaaaacgtggactgtcaaaatcaaatacaacggagcggctttcgcacacgatgccatcgaacgaacggcgcaccatctgacccgcatgatgaaagcggcggtcggaacgcctgacgcgcccgtgcgggaactcggccttgtttcaggagaagaagagcggcagattgttgagatattcaatgatacgaaaaccgcgcttccggaagaggaggccgttcaccgtttgtttgaagcacaggcaaaccggacgcctgcaagcatcgcgataaaagaagcgggacgcgaatggacctaccgtgaagtgaacgaagcggccaaccgcctggcgagacaccttgtgaagagcgggctggaaaaaggccggaccgccgctattatgaacgaccggtctgcggaaaccgttatcggaatgcttgccgtcctaaaagcaggcggcgcctatgtgccgattgatccggcttttccggaggaccgtctccgctttatggcggcagacagctcgattcggctcgtgctgacagttcaggactatcaagaacaagcgggcacattgcaagtcccgattgtcatgctgaatgaaagcgcggatgaaacggtaagcggaacagacttgaatctcccggccggcggcaacgacttggcgtatatcatgtatacatccggatcgaccggcaaaccgaaaggcgtcatgattgaacacagaaatatcatcaggctcgtcaaacattcgaattacgtgccggttcatgaagaagaccggatggcgcaaacgggagccgtcagctttgatgccggaaccttcgaagtcttcggcgcattgctgaacggagcggcattgcacccggtgaaaaaagagacgctgcttgacgccggacgattcgcccaatttctgaaagagcagcggatcacgaccatgtggctgacgtctccgctgtttaatcagcttgcccaaaaggatgccggcatgtttaacacgctccggcacctcatcatcggcggtgacgcgcttgtgccgcatatcgtcagcaaagtgaggaaggcatcaccggagctgtcgctttggaacggctacgggccgacggagaatacgacgttttcgacgagttttctcattgatcaggactacgacggttcgatcccgatcgggaagccgatcggaaattccactgcgtacattatggacgaaaaccgcaacctccagccgatcggcgcgcccggggagctgtgcgtcggcggaagcggagtggcaagaggctatgtgaatctgcctgaattaacggagaagcagtttgtccgcgatccgttcagaccggatgaaatgatataccggacgggggacttggcgaagtggcttccggacggcgcgatcgagtttctcggcagaattgacaaccaagtaaaggtccgcggtttcagaatcgagctcggcgaaattgaggcgaaaatcagccaggcggagaatgtgacggagtctgcggctgtgatccggaaaaataaagcggatgaaaatgaaatctgcgcttactttaccgcagaccaagccctttcgccggaagacctgcgcaaaacgctttcggaatcacttccggaatacatgattcccgcgcacttcatccagatgaatcagtttccgctgacggcgaacggaaagattgataaaaaagcgctgcctgagcctcaggctgaagccgttcaaaaagaatacgaagcgccgaaaacggaagcggagcagaaactcgcggacatttgggaaggcattctcggtgtaaaagcgggtgtgactgacaatttcttcacgattggcggacattctttaaaagctatgatgatgaccgctaaaatccaggagcactttcaaaaagaagtgccgattaaagtgttatttgaaaagccgaccattcaggagcttgcgcattatttggagaatgagagcgaggaggaacagcagtttgaaccgatccgacaagcgccttatcagaagcattatcctgtttcctcagcacagcgcaggatgtatatccttaatcagctcggacaggccagcacgagctacaacgtccctgctgtacttctgctggaaggatcagtagacaaaaaccgtcttgaagaggccatgcaggcattaatcaaccgtcatgagacactgcgtacgtcgtttgacatggcagatggagaagtcgtgcagaccattcataaaaatgtgtcgtttgagcttgaaaccgccgagggccgggaagaagatgcagaagagctgacaaaagcctttatcaggccgtttgcgctcaatcgtgcgccgctggtccgttcgaagctgatccggcttgaagaagaccggcatcttctgctgattgacatgcaccacattattacggacggaagctcaatgggcattttcatcggtgatcttgcgaagctttatcaaggcacggagcttgagctgccaaagattcattataaggatttttcagtctggcagcgtgaaaaagcaaatcttgatcagcacgaagcttactggcttgatacgttcaaaggcgatctgccggtgctggatctgccgcttgatttcccgcgtcctgccgagcgcagttttgaaggggaacgcgtcatcttcgggcttgataaacaggtgacggcgcagattaagaagctgctggctgatacggatacgacgatgtacatgttcttgttagccgcttttcaagtgctgctgtccaaatattcggggcaggaagacatcatagtcgggtctccggcggccggaagacagcatcctgatctccaagacgtgccgggcatgtttgtcaacacagttgcgcttcggtcgcatcctgccggcaaaaaaacgttcaagcaatttctggatgaagtgaaaacggcgagccttcaagcttttgagcatcaaagctatccgcttgaagaattaattgaaaaactgccgttaacgagggacacaagccggagtccgctgttcagcgtgttatttaatatgcagaacatggagatcccggccctgcggctcggagatttggagatttcttcttactccatgcatcatcatgtcgctaaatttgatctttccttagaagcggctgagcgcggagaagaggtcggattgagctttgattacgcgaaagccttatttgcggacgaaaccatccgccgctggagcgctcattttgtcaatctgattaaagcctgcgccgaaaatccggatattcagctggccgacgcaagcctgctgtccgctcctgagcgggaagcgctcctttctgatgaaaaacggacggaagcggatctgcctgagggcacttttgtttcgctgtttgaacggcaagcgcaaaaaacgcctgatctcacggcggttgcgggcggaacaagtctgacatatcgtgagcttgatgaacgctcgaaccggtttgcccgacaccttcaggcttgcggaacgggcagtgaggacatcgtggccattatgatggatcgttcggccgacttgattaccgcgattctcggcgtcatgaaagccggagcggcatttctcccgattgatccggagactcctgaagagagaatccgctactctctcgaagacagcggaacgaagcttctggtcgtcaatgagagaaacatgaccgcggccgccgtttataaaggaaaaacggtcgtaatggaagacggagaatggcagaacgaaagcgccgaccggcttgaaacggagcccggcgccgaccggcttgcctatatcatttatacctcgggaacaacgggcaaaccgaaaggcgtccagctggagcaccgcaatctaatcaattatgtcacatggttcagccgtgaagccggtttgaccgaagctgacaaatccgtgctgctgtcttcttacgcatttgatctcggctatacggccatattcccgattcttcaggcgggcggcgagctgcacattgtgccgaaagagacgtacaccgcgcctgatcagcttggtgagtatatacagaaaaacggcattacgtatatgaaactgacgccgtcattgttccatatgatcgtcaatacagcccgttttacgtcagaacgccgtttcagcccgcttcgtttagtggtgctcggcggagaaaagatcatcacgtccgatgtccgcaagtttcatgacgtatacgcccataccgacttcatcaatcactacgggccgacggaaacgacgatcggcgccattgcggaacggatcaatatggagcgtcttgatcaatatgagcagcgtcccgtcatcggccgcccgatcgcaaataccggcgcgcttgtattggacggagcaatgcagctcgttcctccgggcgcaagcggcgagctttatattaccgggaaggggcttgccagaggatatcttcaccgtccgcagctgacgggggagaaatttctctcaaatcctttttcaccggacagcctgatgtacaaaacgggagatgtcgtccggaggcttcctgacgggacgattgaatttatcggccgtgcggatgatcaggtgaaaatccggggctaccgcattgaattaaaagaggttgaaaccgtgctgttaagcgtaaacggcattcaggaggcggtcgttctcgcagtcagcgaaggcgggctgccggaactgtgcgcgtactataaagccgacagcgggctgaaaggctctgagcttcgcaaacggctttccgaaacactgccgtctcatatgcttccggcctatttcgtgcaagtagaccgcattccgctcacagccaacggaaaaaccgataaaaacgccctcccgaaaccgggcgtcagccaaacggcgcaaattgcttcagccttgccggaaacggaattggaggaaaagctgtgccgcatttggaaacagacactcggtacggatacgctcggcatcgacgataatttcttcgattacggcgggcactctttaaaaggaatgatgctcctcgccaatattcaggctgaactggacaaaacggttccgttaaaagcgctgttcgaacagccgactgtccgcctgcttgccgcatatatcgaaaaatcggcggtatctgagggatatcggatgatcacaccggcagacagtgcagacgcgtacccgttatcatccgcccaaaaacggatgtacgtcctgaaccagcttgaccgggagacaatcagctataatatgccgtccgttcttctgatggaaggagaagtcaatatttcaaggcttcagaaagcgctcaatcagatgatcaaccgccacgaatctttgcggacgtcctttatcgatcaaaaaggccagccgatgcagcagatcgcagaacaggctgacattgacctgcacatctttgaagcagcggacgaggagaaagcggatcttatcattcaggcattcattaagccgtttgatctgagcgcggctccgctcattcgggccgctcttgtcagactgaatgaaaagaaacacctgctgctgctggatatgcatcatatcattgccgacggcgtgtccagaagcatgctggtcaaagagctcgctcacctttacaaaggcggaagtctgccgtcgccgaacctgcactataaagacttcgccgtctggcagaatgaacctgagcaggccgaacggatgaaagaccatgagtgttattggctctccgcattttccggcgagcttcctgaattgaatctgccgaccgattttccccgtccgccggttcaaagttttaaaggacaatccgtccgtttcagagcggggcgtgagacggaaaaagcggtgcgtgaattaatggaatcatcgggagcgactcttcatatggtgcttcacgccgcgttccatgtctttttgagcaaaatcacgggacagcgcgatatcattatcggttcggtgaccgccggaagaacgagcgccgaagttcaggaaatgccggggatgtttgtcaatacgcttgcgcttcgcaatgaaacgcaaaaagagcagaccttcgccgggctgctcgaacgggtgaaacaaaccaatctcgacgcgctggcgcatcaggattatccgtttgaggatctgatcggaaagcttgacctgccgagagatatgagccgcaacccgctgttccaggtgatggtgacgacagaagatccggataaagaaacactggaactggagaacctgcgcatcactccgtatgagtcaaaccaaggcacggcgaaattcgatctgacactcggcggctttacggatcaagaaggtctcggccttcagtttgaatatgcgactgatctgtttaaaaaagaaaccattgaaaagtggagcgccgggttcctgcggattctgaagcaagcggcggaaagcccggacagaaagctgcctgagatttcactgatcagcgatgctgaaaaacaagccctccttgacgcatggaaaggaaaaacactctctgtgccgcgggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtgccggatggctacacaggagatacgattctgcttgacggcggacgctccattctgagcctgccgcttgatgaaaacgatgaagcgaacccgcagacggaaacaacggcggatcatctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggcttcggttttgacgcctccatctgggagatgttcccgacatggaccatcggcgcggaacttcacgtcattgacgaagcgatccggctggatatcacccgcttaaatcactatttcgaagagcacggcgtaaccatcaccttcctgccgacgcagctggccgaacaatttatggagctggaaaatacctctctccgcatgcttctcgtcggcggcgacaagctgaaacgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggcgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcgggcgtattgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgcttccggactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttccgacatttggcaggaagtgctcggtcttggtcagatcggcgtaagcgataatttcttcaccctcggcggcgactcgatcaaaggcatccaaatggcgagccgcctgaaccagcacggctacaagctggagatgaaagatctcttccagcacccgaccatcgaagagctcgtctcttatgtggagcggacggaaggcaagcaggccgatcagggacctgtcgaaggcgaagcggagttaacgccgatccagcgctggttctttgagaaaaatttcacggacaaacaccactggaaccaatccgtcatgcttcacgcgaaagacggctttgatccggacctggtggaaaaaaccctgcaagcattgattgaacaccatgatgcgctccgcatggtttaccgtgaagaaagggaaggcatcattcagacatacctccctgtcacagaatgcaaggcaagctttgaaatcgttgatctgtacggaacggacgaggatatgctgaaaagccagattcagcggcttgccgatcatcttcagggcagtcttgatctggagaacggcccgctgttaaaagcggagcaataccggacagaacaaggcgatcatctgttaatcgcggttcaccatctcgtcgtggacggggtttcatggagaattctgcttgaggatttcgcttcaggttataaacaggcgcagcagcaaaacagcatcgtcctcccgcaaaaaacccactcctttaaagattgggcggaggcgctgaacacgtttgcgcaatcagaagagctgaaaaagcaggcggattattgggcgcaggcagatgcggaagaactgcggccgctgccgaaagaccatgatccggacaaacggctcgtcaaacatacggcggccgtgaaatgtgaattgactgaggaagaaacggcacagctgctgacagatgttcatcatccgtacggaacggaaatcaacgacattctgctcagcgcgctcggcttaacgatcggtgaatggacggaaaacggcaaagtcggcatcaacttagaaggacacggccgggaagaaatcataccgaatgtcaatatttcacggacggtcggctggtttacggcccaatatccgttgattctgcagatcagcaaggaagacggcgtctcttccgtcattaaaacggtaaaagagacagtgcggcgcgttccagataaaggtgtaggatacgggattctccggtatctgtcatccgatgaaacagaaaaaggcgccgcgcctgaaatcagttttaactacttggggcagtttgacaatgaagtgaaaacggaatggtttgagccgtctccatatgatatgggacgtcaagtcagcgaagagtcagaggcgttatacgcactgagcttcagcgggatggttacaggcggccgcttcgtcatttcctgctcatacaatcaggaagaatatgaaagaagcaccgtcgaaacacagatgcagcggtttaaagacaatcttttaatgatcatccgccattgcacggccaaagaggagaaagaatttacgccgagcgatttcagcgcgcaggatcttgagatggatgaaatgggagacatctttgacatgcttgaggagaatttaacgtgacaaaaacagttaacagaaggggggagcggagcagatgagccagttcaaaaaagatcaagttcaggacatgtattatttgtcgccgatgcaggagggaatgctgtttcatactctcctgaatcccggccaaagcttttacatcgaacaaatgacaatgagagtaaaaggcagcttgaatatcaaatgccttgaagaaagcatgaatgtgatcatggaccggtacgatgtatttcgtaccgtgttcattcacgaaaaagtaaaaaggccggtccaagtcgtattgaaaaaacggcagtttcagatagaagaaatcgatctgacacacttaacgggcagcgagcaagcatccaaaattaatgaatacaaagaacaggataagatcaagggctttgatttgacgcgggatattccgatgcgggcagccatctttaaaaaatcggaagaaagctttgaatgggtgtggagctaccaccacatcattttggacggctggtgcttcggcatcgtcgtgcaggatctgtttaaggtatacaatgccctgcgagaacaaaagccgtacagcctgccgccggtcaaaccgtataaagactatatcaagtggcttgaaaagcaggataaacaagcatcactgcattactggcgcgggtacttagaagattttgaaggacaaacgacatttgcggagcaaagaaagaaacaagagaacggctatgagccgaaagagctgctcttctcactgccggaggcggaaacaaaagcatttaccgagcttgcaaaatcgcagcataccactttgagtacggcgctgcaggcggtttggagtgtattaatcagccgctaccagcagtccggcgatttgatcttcggcacagtcgtttccgggcgtcccgcagaaatcaaaggcgttgaacatatggtcgggctgtttatcaatgctgttccgaggcgggtgaagctgtctgaggataccacatttaaaggcttgctcaagcagctgcaggagcaatcgctgcagtctgagcctcatcaatatgtgccgctctatgacatccaaagccaggccgatcagccaaagctgattgatcatattattgtgtttgaaaattatccgcttcaggatgcaaaaaatgaagagaacagtgaaaacggctttgatatggaggacgtccatgtttttgagaaatcgaattatgatctcaacctgatggcttctccaggtgatgagatgctgattaagcttgcctataacgggaatgtgtttgatgaggcgtttatcctgcgcttaaaatctcagcttctcacagcgattcagcagctcatccagaagccggatcaccctgtcaatacgatcagacttgttgatgaaaaggaaagagagcttctgcttaccggcttaaacccgccggctgagactcatcaggcgaagcctctgacggattggttcaaggaagcggtgaatgtaaatcctgatgcaccggcgcttacgtattccggccagactctttcctatcgcgaattagatgaggaagcgaaccgtcttgcgcgccgtttgcaaaaacaaggtgcgggtaaagacaccgttgtcgcgttgtacacgaagcgctcgcttgaactggtgatcggcattctcggcgtattaaaagcgggagcggcttatctgccggttgatccgaagctgccggaggaccgaatctcgtatatgctgactgacagtgcggctgcctgtctgctgacacatcaggagatgaaagaaaaagcggctcagctgccgtatacaggaacaacactcatcatcgatgatcaagcacggtttgaggaacaggcaagcgatcctgcagccgcaattgatcccgatgatccggcgtatattatgtatacgtccggcacaaccggaaagccgaagggcaatatcaccactcatgccaatatacaaggattggtcaagcatgtagactacatggcattttctgaacaagatacgttcttatctgtttcgaattacgcctttgacgcatttacttttgatttctacgcatcaatactgaatgcggcacggctcattatcgcagatgaacatacactgcttgatacagaacggctcactgatctgatccggcaggagaatgtcaatgtcatgtttgcgacaaccgcactttttaatcttctcaccgatgcgggagaggagtggctgaaggggctccgctgtgtgttattcgggggtgagcgcgcgtctgtgcctcacgtcagaaaggcgcttgagatcatggggcctggcaagctgattaattgctacgggccgactgagggaacggtgtttgcgacagctcacgtcgtgcatgatataccggattccatttcctcattgccgatcggaaagccgatcagcaatgcaagtatttatattcttaacgggcaaaaccagcttcagccgttcggagctgtcggtgaactgtgcatcagcggaatgggtgtatcaaaagggtatctgaaccgtcacgacctgacgaagcaaacatttatcccaaatccgttcaagccgggagaaacgctttaccgcacaggggatttagcacgctggctgccggatggaacgattgaatacgccgggcgtattgacgaccaggtcaaaatacgcggtcaccggattgaacttgaagaaatcgaaaagcagctgcaggaatacccgggtgtgaaagatgcggtcgttgttgcagaccgccatgagtccggagatgcatcaatcaacgcctatctcgtgaaccggacgccgctttcagctgaagacgtaaagaggcacttgaaaaaacagcttcctgcttacatggtgccgcaaacctttactttcttagaagagcttcctttaacgacaaacgggaaggtcaataaacggcagctgccgaaaccggatcaggctcaggcggcgaaagaatggatcgggcctcgaaacgcgacggaagaaacgattgcacacatctggtccgagattctcggcagacagcagatcgggattcatgatgatttcttcgcgctcggaggccattccttaaaagcgatgacggcagcgtcgcgcattaaaaaagagctcggtacggacatcccggtgcagctgttattcgaagcgacgacaatcgcagacattgccggttatctgcttcacggtgaagaaaaaggaatgaaagatctcaccatcatgaataaaaatcagtctgacacactgtttgcgttcccgccggttctcggttacgggctgatgtaccagccgctggcaaaacagctgtccggctatagaatctgtgcgtttgattttatcgaggaagacaaccgcatcgaacgctacacagagctgatcaatcagctccagccggaaggaccggtcaagctgttcggatactcggcaggctgcacgctcgcctttgaaacggccaaacggcttgaagccgaaggacgtaaagtggagcggctgatcatggttgattcctataaaaaacaaggcgtcagcgacttggaaggccgcaccgtagaaagcgatgtccaggcgctgatgaaggtaaaccgggataacgaagcgctgaatgacgaagccgtcaaagaaggtctcgccaaaaaaacaaacgcgttttattcttatttcgtgcataccgtcagcaccggcacggtcaatgcggatatagatctattaacgtcagaaccggactttgcgatgccgccgtggctcgcttcgtgggaggaagccacgacaggtgaataccgtgtgaaaaaaggctgcggcagtcacgcagaaatgctacagggagaatgtctcgaaaggaatgcggcatatttgctcgaattcctaaggaaggaacatccgaagctgacagcttcacgatagaaaaggaggaagcccgccaatggtccagctctttaaatcgttcgataccacggaaaaaacgcagcttatctgttttccgttcgcaggaggctattccgcatcattccgcccgctccacacctatcttcaaggtgagtgtgagatgcttgccgcggaaccgccgggacacggaacaaatcaaatgtccgccgttgaggattttgaacagcttgtcagtttatacaagcaggagttgaatctccatcctgaccgcccgtttgtcctgttcggccacagtatgggaggcatggtcgctttcaggctggcgcaaaagcttgagcgggaggggatttacccgcaggccgtgatcatctcagccattcagccgccgcatgttgaaaggaaaaaagtgtctcatcttgatgatgaaaaatttctcgcccatattatcgagctgggcggaatgccgcaggagttagtggagaataaggaggtcatgtcatttttcctgccttctttcaggtccgactaccgcgcgcttgaaagcttccgtccgtctgattctcacatgattcaatcacccgtccatatttttaacgggcggaaagataaaaaatgtatcaaagatgcggacggatggaaaaaatgggccgacaatcccgtatttcatgagttttcggacggccacatgttcatattaagtgaaactgaaaaagtggcggaacgaatatatgagattattaacaggagcactgcaggccaattgttataggagatgacagacagcattcgctgtctgttttttgtaacaaaatctgcccgtgagttttctcatttatcaaaaattttatgttatgatttgatggaatataattttgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcgggattgccacctcacaaggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttaacacacgggctgagcattgccgccgacttgttcgtcaatgaaggggatgcgctgcttctgccggataaatattggggaaattacaattttattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctatacgccgggggaagaggaagcgtcagaaatcgtcagtgtgatcctggaggcggcggaggccggcaaagagattgtcgtgctcgtagacgatgcgtattacaatctgttttacgatgaaacggccattcaggaatccatcttcagcaaactcgcccaagtgcacgaccgggtgctttgcgtaaaaatagacggcgcgacgaaggaaaattatgcgtggggcttccgcgtcggttttattacgtacagcacaaaaagcgaaaaagcgctgcgcgtgctcgaggaaaaaacaaaagggattatcaggggaacgatttcaagcgccccgcatccgtcccaaacgtttatgctgcgggcgatgcagtcaccggaatacgagaaagaaaaatcgctgaaatataatatcatgaaaaaacgggctgacaaagtgaaagccgttcttgcagaaaacaagcactatgaagacgtatggacgccttatccgtttaactcgggttatttcatgtgtgtccggctgagagacataaacgccggtgaattaagagtgtccttgcttgaaaagagagggatcgggacgatatccattaatgaaaccgatttgcgaatcgcattttcatgtgttgaagaagaatacatcgcggatctgttcgaagaaatttatcaagaagcaaagcagctgcagaaacaggcggaaatatcaggctgacaaaaaaaggagggggataccctcctttttctatgcttacagcagctcttcatacgttttcatctcaatcccgtcacaaaaatcgggatgcgccgcacaaacggccagcttatattcctcgtccgcatcatatgtgcggatgaaacaaggttcatgtccgtccgggagctcaatggacacatggccgtcgtctttgaggcggacgctgaatgaatcaagcggaagggaaagcccttttccggcctgcttgataaagctttctttcatcgaccacaggtggtaaaaataatcggtctgctgatcggggtgtttcgcttgcagatcactgtattccgtcggcgaaaaaaaacgtttggcgatatcaatcgtgccgggcttcattttttcaatatctatgccgatcggttttgaatcaacggcacacacgatccagcgcccggagtgggaaatgttaaagtgcatgtccggaagcgcggggatgtacggctttccgtattcctggacgctgaatgaaatcccggccggatcaagtccgtaagccttcgccgcagcggtgcggatcagcatgtcgccgatcaaggtgcggtgagcatcctccttatggtaaaagcgccggcatttttcccgcttttcggcggacacggccgccatcatccgatcctcttcccctgcagaaagcgggcggtccatatatactccgtaaatcttcatgtccagatcctccgtctgaaaatattgtcaaaaccatcctaccatatcagacgaaagctgtccgaaaataaaaaaacaaaaccgtttcggctttgtttttaatgaacggacgttgcccgcccggagatcgcgtatgttaacagtttagaggactgcggcaaagaaaaacgcagaatcagccccgtcaaaacagccgtaataatggttccggcgccgatcggtccgcccatcacccaggctgcggcaagaatcgtcagctcaatgccgttccgcacccattgcacgttccagcccgttttttcagatatcagcatcatcagagagtcccgggggcccgcgccgagccctgctgatacgtaaataccgacgccgcagccgatcagcagcaatccgatagaaaaaaacacggccgctaaggaaaaagcgtgcgcctcaggaagcagaaacgagaagaaatcaataaacattcccatcagcaccatgtttaagatagcgccgattttcgggagcgtcctcgtgaacaggcaggttaaagccacgatgaccgcgccgaccaagatggaccattggccgacagatagcccgaaatgctgaaaaagcccataatgaaaggcatcccaagggctgatgccgagagcttttcctttaatggttaacgataccccgaaagacaaaatcaacagaccggcaaaataaaacgtccagcgcatcaagaattcccgcttcaaagaggtcccttctttcataacattcattaattgtcattgtagcataaccgcccaaaaaaagaagaagcgaaatcagtgtttcgcttcttctccggctcctacaaaggattcagtatacgatttaaaaaccgctgcgtgcgttcttctttcggcgcggaaaaaatctgggccggcggtccttgttccacaatgacgccgccgtcaatgaagatgacttcatcggccacttcctgcgcgaatttgatttcatgggtgacgacgaccatcgtccagccttcgttcgccagatccttaatcactttgagcacctcgccgaccagctccggatcaagtgctgacgtcggttcgtcaaacagcatcagctcgggctgaatcgcaagcgcgcgggcgatgccgacccgctgctgctgaccgccggaaagctggaacggatataaatccattttgtctttcagtccgactttttccagaagctctatcgcttcttttctgacttgctccttgtcgcgcttttgcacttgaacgggtccttccatgacgttttcaagcgccgtgcggtgaggaaacagatgatacgcctgaaagaccatgcctgatttgcggcggaggcggagaatatcagcctgcttcacttttttggagaaatctattgaaaaatcggagaatgccagctcgccgcgattggggatctcaagcgcgttcagacagcgcagaagcgtcgtttttcctgaaccggacggtcccagaatggcgatgactttccctttttctatctccatatctatcttttttaaaatttcattctgtccgaatgatttatttaatcctttgacggaaagcatatcgaaacctccttatttggccacataacggtcgagacgccgttcgatcacatgctgtacgattgacagcaagaagcagatgatccaatagataaaggcagcttcaatatagatgaccaagatttgatcaaggttttgcgcgccgatttcctgcgcttttctgaacagctccgcgacgagaatctgtgacgcgagagatgtatccttgatcaggctgataaatgtatttgataatggcggaatggacacgcgaaacgcctgcggcaggatcacgcggaacaatgtcttgcgataggtcatgccgatcgtataaccggcttcccattgccctttcggcacggatgaaatagatgcccggatgatttcagaagcataggcgcccacgtttaatgaaaacgcgatgactgcgcttgggaaagggtccagcgtaatattaaatgtcgggaacagataaaaaatgatgaacaattgaacgagaagaggagtgccgcgcaccgctgatacgtatacgctgaacacccatctcaatggtttcatatttgacattctggcgagcgccgtaatcagcgcgatgatcattccgaaaataaaggaaagaatggtaaggggaatcgagtaatagattcccccggaaagaatcggccagaatgactgctgcaccaaatcccacggaatggctgttgcaatcacgggttccggcatgttacttagaaacatcttcgccgaaccattttttcgctattttagaaagagtcccgtcctctttcatttcttttaacgctttgttgacgtgagtcacaagttcgccgcttccttttcggaatgcgaaatatgtctgctgcggctggcctgcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgctgtttttcctttgacatcagcctctttcgcaatcgtgctgtcttttttcgtcacgacgactgcatttgacgttgtgtatttatcagaaaaatcatattggttctcacggcctgttttgccgacttggttggcgacgacgtcaaaccgtttcgcgtttaaaccggcaaacatgctgtcccattgtgtttctttaaagtcagctttcagaccgaggcgtttcgcgacttcttgaatcacttcaacatcatatccggtcagtttgtcagtctttttatcatggaaggtaaacggttcgtacgttccttctgtaccgacggtcagtacgccttttttcttgacagaagcccaaagatcgccgtcttttgacttagatccgctgtcctgtgagtttccgcaggctgcaagcattgcgatgctgaccatcatgaacaaagcgaataatgcttttttcatcttctttattccccacttttctgagtagttttattgagaaaaaatagctcccaattgtaaaggataacttttttttagtatgagtcaagtaattggttttcataagcgggaattcatcgtgttccggatcaaaataattccaaaaactgtctgacaggcttcggcaggtagctgtcttttctccagatgacggccggtgtcatgacaaacgggttgtcttcgatgataaccgttttgacatgcgagcgcatatggacgggaatcatcgtcaaaggcagaattgtggcgccgaatcctgatgatacaaggctcaagagcgtcgcggagtcatggcattcacaaacaacctggaggtcgagaccgtactgttcacaaacttggaggacttggtcatacacacctcttccattgacggtgcgcaaaaggatcagaggcaaagaggcgatgtcattcagtttaatcgtttctccgcacagtcgttttgaatgctcggacagcaccaatacacacggaatgtcttcaagctccttcgattcaatgccgtcgtttttaatcaaagtggtggtgacggcggcgtcaatctgccgggtttccagaagctcgagcagtgagacgggctcatcttcccaaatgttaaaggtgagatgcggaaaccgctctttcatctgtgacactttctcaagcataagcgctgcgcagtaaatggttgacccgacggcaagtgtcccggccacctcctccttcagctcttgtacctcgattatagcgtcctcaaacttatgaagaatctctttcgctcttttcaaaaagacgtttccttcatatgtgagggtcatttgtttctttttattgcggtcaaacagaatgacgcccaattcttcttcgagctgtttcaactgtcggctcaaaggcggctgtgccatatggagctttttggcggccgtcgtgattttctgctcttgggcaatggtgatgaaataacgcaattgccgaatatccatgagaacgctcgctcctttcttttatacctttaaggtatgatacatagatttaacgaatatttttcatatggatatatcaggagtatgatggatttgacaccacatttcaagcgtaaaggaggggtcaatatgaagctcgtcatcggaatgaccggggcaacgggagccatattcgggatcaggcttttagaatatttaaaagccgcggagatcgaaacccatcttgtcgtgtctccttgggcaaatgtcaccattacacatgaaaccgattatacgttaaaagatgtcgagaaactcgcatcctatacgtattctcacaaagaccaggcagcggcgatttcaagcggttcgtttgaaacggacgggatgatcatcgctccgtgcagcatgaaatcactggcaagcatccgcaccggaatggctgacaatctgctgacaagggcggctgacgtcatcctgaaggagcggaaaaaacttgtgctgctgacaagagaaacgccgctcagccaaatccatttagaaaatatgctagcgcttacaaaaatgggttccgtcattcttccgccgatgccggcattctataacaagccggctgacatggatgaattgatagaccatattgtgttccggacgctcgatcagttcggcatccgtctgccggaagcgaaacggtggtacggaattgaaaaacaaaaaggaggaatctgataatggcctatcaggattttagggaatttctcgccgctcttgaaaaagaagggcagctcttaaccgtcaacgaagaggtaaaaccggagccggacctgggcgccgccgcgcgtgcagccagcaatctcggggataaaacccctgcgcttttgtttaacaatatttacggacatcacgatgcgcaggtggctctgaatgtcatcggctcgtggccgaatcacgcgatgatgctcggcatgccgaaagatacgcctgttaaagaacaattctttgagtttgccaaacggtacgatgcatttccggtgccggtcaaacgggaagaaaccgcgccgtttcatgaaaatgaaataacggaagatatcaatctatttgacatccttccgctattcagaatcaaccagggggacggcggctactatttggataaagcgtgcgtcatttcccgcgatcttgaagatccggacaatttcggcaagcagaatgtcggcatttacagaatgcaggtaaagggaaaagaccgcctcggcattcagcccgtgcctcagcatgatattgcgattcatcttcgccaagctgaagaacgcggcgtgaatcttcctgttacgatcgcgctcggctgtgagccggtgattacgacggctgcatcaactccgctgttatacgatcaatccgagtatgaaatggccggcgcgattcaaggggagccctacagaatcgttaaatctaaattgtctgatttagacatcccttggggtgctgaagtcgttctggaaggagagatccttgcgggagaacgggaatacgaaggacctttcggtgagttcacgggccattattcaggcggccgcagcatgccggtgatcaaaatcaaacgggtatatcatagaaacaatccgatttttgaacatttatacttaggcatgccgtggacggagtgcgattatatgatcggcattaatacgtgcgtgccgctttaccagcagctgaaggaagcctatccgaacgaaatcgtcgccgtgaatgcgatgtatacgcacgggctgatcgccattatctccacgaaaacgcgctacggcggatttgccaaggccgtcggcatgcgcgccctgacgacgccgcacggactcggctactgcaaaatggtcattgtcgtggatgaggatgtcgatccgtttaacctgccgcaagtcatgtgggcgctctcaacgaaaatgcatccgaaacacgatgcagtcatcattcctgatctgtccgtccttccgcttgacccggggtctgatccggcagggatgacacacaaaatgattcttgacgccacgacgcctgtcgcgccggaaacaagaggccattattcgcagccgcttgattccccgctgacaacgaaagagtgggaacaaaaactgatggacttaatgaatcaataagaaaggatgagtttactatgaaaacatgcccgcgctgtgaatcgcaaaaaggagaaaccgtcagccaatcgccggtcaaaggcgcttgggaaatataccaatgccaaacctgcttttttacatggagatcctgtgaaccggaaagcatcacgaatccggcggcattcaacccggcatttaaaatcgatccgaaagaaacagagacggccacacatgttcccgctgtcccggaaagaaaagcgtaatgctgacggagcacttgccggaggcgctttacacgcttttagacggaacggagcttgaaaaaaagcagcacgacgcatttgtgctccaatccgtgacaaaagaaggccgtccgcacgcggccatgatcagcgccggtgaaatcgcggccgtgagcagaacaaatctccggctcgccttatggaaaaacacgacgaccgtaaaaagcctgctgcattcgggacaagctcttttcatcgcctggcacggaggagccgcatattacgtcacattggaatgtaaggcgcttccgccgctgaaagaggcgaaacacgagcgggaacggttcagctgccgcgtgatcaccgtcaaggaagatcgggcgaaatacgcggatctgatatccggaccggccatccagctccacgaaccggaagatgtcctgaagagatggagagaaacacttgaggagttaaaacgatagacgcacaaaaaaagcctgcggacgattccgcaggcttttcttttattgtacgcctttcatcgcccgtttaatgacgggagacagaagaattaaaataataccgagaatgatcgaaacaagcccgattgagccgaagtaggccgcttcagaaatcttatcaaacaaaccgactacttttgcgttcagggcttgaccgcaggcgtttgttaaaaaccacatactcatcgtctgcgctgagaaagctgcaggcgcaagtttcgttgtgacggataaaccgaccggtgaaaggcaaagctcaccaagcacaaccaaaaggaagctgagcacaagccaaagcgggctcacaagctcgccgcttccgcccataaccggaagcaccatgactaaaaatgataatccggcaaggataatgccgatcgcgaatttaatcggtgttgaaggctggcgtttgccgagcttcatccagatccacgcgaacaccggcgcgaaaataacgatgaataacgggttcagagactggaaccatgaagactcaagatgcatgcccgcaaaggaaagtctcgtgcgctgatccgcatataaagctagaatcgtcgcgccctgctcctgaatcgcccagaacattgccgctgcaataaacagcggaacataagccgcaagccgtgatttttccgttttcgtcgcttttttgcttgtgaacatcacgataaagtaaataaccggaatgacaatgccgaggatactgacggtgtcaatcacacgctggatcgtcagccagccggtttgaatcagaacaataataacggctgctgcgatgaccactccgattcccgtgccgatcactgatgatttagaaatcggattcggtacattggagcctgctttgccgaggtatttctttctcgtaagagcgaaaacaatcagtccgaggaacataccggccgcggcgcatccgaagcctaagtggtagttgtacttctgtccgagtgttccgacaattagcggcgcaagcaatccgccgaggttgatccccatgtaaaagatgctgaaacctgagtcgcggcgctcgtcttccttcgtatataaatctccgacaacgctggatacgtttggtttaagcaggccggttccgataatgatcagagccatgctggtaaaaaacgccgccgtgctgccggggaaggcaagagcgatgtgcccgaacataattaaaattccgccgtaaaatacggtgtttgccgtgccgaatacccggtcggccagccatccgccgatgacgctcgacatatatacgagagacccgtatatggacatgatggcaactgcggtcgttttatcaaagccgagaccgccatgagcgacttccgtgtataaatagtaaagcaatatggctctcataccatagtaggagaaacgctcccaaaattcggtaaaaaacagtgtgaacaagccgcggggatgaccgaaaaagcctcgttgcggcacagtttctgttatagattccttatcaatagatgccacctgagccaaccctttcttaaaaaagtgtattacaaaaatcatattcttatataatacttgtgtcaatataatttatactgaattcaaaaaattccagaatgaaaagatattaaaacggtgaatatagacgaattttcctgattccaatgacttattttgttatattatctgactaaactatctttataaacttttttaataaaatttaaagtatgtacaggcggagcgggatatggcggaataagatgacaataagagaggaaggaggagattatcacttgccgaatcgtatattggatattacggattgcggtgtggcggcagacggaaaaaccgatgtgacgggcgccatcaaccaatgcttggccagagccgtcagcgaaggctgtcatacggtgttttttccgcccggaacgtataaaatcaacggcacgcttggcggggacaaaagccagccgtttcggaacgccgggattaacgtgccgagccatctcaccatcgttttagatccggaatgcacgattaaagtggcgccgaacagctcctggggctactcggctttctatataggcaggcgtgaaaatgtcaccatcaccggcggccggatcatcggggaacgggatgaacacacgtataccaatgtccctttgcggtcgacccatgaatgggggtttggaatctgtattgaaggcagcagcaatgtgctgatcgaaaatgtgaagatttcagattttacgggagacggtataattgtcagcccgctcgggttaaaaacaaacagtgattacgaaacttcagaacaggtgaccatccgccgctgtgagatcaggcagtcaaggcggaacaacatttcaatcaccggctgcaataccgttacggtggaagaatgcgtgattgaagacgccgggcaagggaacggaacggctccgaaattcggaatcgatattgaatcgtacggagaaggcgatattgattatgaagaagctcttcatattacggtccgcaacaacttcttttccggaaacgccgcaagctcagtcaccaattttaacggatataatgtgttaattgaaggaaatcattccgataacacaatcagctacgggtatggggcgcataccgtcattacggggaatgtcttctttcggtcagacggcggctcaaggaccgcagtcgccggacaaggtgtgtcacaaggacaggacagcagcagtgccgtcatttccaacaatctgattaccgggttttccaccggaatagatgtaaggggaaaaagcgtcctcgtcacccacaacaaaattaatcaatttgaaaatacgggcatttccgtctatcaggcagaagatgtgaccgttgacggcaatgtcattgaaaacggacgttccgaaacgagacgaagcacggggatgcgggcgacgctttcggagaacgccgtctttacgaataacactctgaatcaggtgacagacggaatcagcatgtcggccggcagtatcattgtaaaacaaaatgtgctgaaatcgttcagccggggcatatgggtcacaggcggaaatgccgttattgaaggaaatacgctccttccgaatgcgtatcagggcgccgcggagtcctatgccgtatctgtgacaaatgacgccggggctgtcatcaaaggcaatctctttaagaactataaaaactatcccgtattcagttcaacatcctcgggaacctctgtcatcagcaaccgctttgaatcatcaccgcttatcgttaccgtgtatctgaactcaggcacgcatgaagtcatagacaatatgctcacgatcaaccgaacagcgggcagcccgatcggcatctatctgaacggagcctccaattccctcgtttcgggcaataccatcaacaacctttccgccgcttctgcttccgccatccaaaccagctcctccgcaagtactaaaatcatcggcaaccgcattatcaaaggcgtcattgtgaagcacgcgacagatacggaaagcggaaatatcgtcatctgagaacaatctgcgccggaaaaataaaaagaacacatgaactccgagagaaggaggaatgtgttcttttttgacacaatacagccttgcgcctgtcaggcatcttttttacctgatttatataaagcgatcatttctctgattaaaaagagggcgaataaaaacagcatcagccattctgagaaggtggtcaatttaaaagcggacaggttgttttgaaccgctccatagaaactgaaaccttgcagcatatccaccgttactgaaatgatcagacaggcagtcagcaaaaagaatgaaacccctaatattttcatgcgcatcactctccctttttatccttttcgattacgcagaacttatacagactttccgccgtgcataatcttttgccgtacaggaagaatatgaaaaaaacgaggaaaggttttttgcgatatgccgccattttttaagcagaggaaacaaaaaaaagccgatcaaaacgaccgtgacaatgaaggcagaaaagaagcggacagccagccggacaaagagcgggatgagccgatctccctcagcttaaagcaaaatatgaagaagctgtctgagaggttcggcaacagtgccgatgtcgtcatccgccggctgaaaatcggaaaagaagagcttccggccgcaatcgtgtatatcgccggtttggtagacgaacagcttgtcagccaatcccttctggaggatttaatcgacatcccgtccgttcagccggaacaagcggtctgcctgatatacgataaaacgcttgcgatcggcggggtgaaagaggaagaaaaatggaaaagcctttatgccgggctggtggcgggcagcacgctcatttttgtcgacggggctgacaaggcgctgatcgccagcacggaagggggagagcaccggtccattcaagagccgagcactcaggtctctttccgcggcccgcgccagggattcactgaatctctgcaaaccaatatttccatgatccgcaggtatgtaaaaacgcctgatgtgtgggttgaaaaaatggagatcggacacgaaacgaatacggatgtcgcgctgatgtatattaacggaatttgcgataaaaagctgattaaggaagtccgcaagcggctgaagcacattgacatcgacagcattctggaatccggctacattgaacagctcattgaagacgcgccgttttctgtgttccccaccgtatatcatacggagcggccggacgtcgtggcggggaatctgctggaaggacgatttgcgattatcgtggacggaacgccgttcgttctcatcgcgccggccttatttattcaattttttcaatccgttgaggattattattcacgatttgatatcgccacaagcatcagggtgctgcgggttttgattttcttcatttcactggtggcgccggggatttatgtggcggcgacgacctttcaccaggaaatgattccgacgcagctgctgattgtcatcgcggctcagcgggagacggtgccgttcccggccgtgattgaagcgctgacgatggaagtggcttttgagattctcagggaggcgggtgtccggcttccgagagttgtcggctccgccgtttccatagtcggagcgcttgtcatcggccaggccgccgtacaggccggcatcgtctccccggccatggttatcgtcgtcgcgctgacggcgattgccagctttgcgaccccggcttttgacatggcgatatccgcgcggctgatccggtttctctttattctgtcagcggcggtcatgggattttacgggctgattctgggcattatcatgatgttcgtccatctgtgcggcctgcgttcattcggttttccgtatatgtccccgctcgctcctttgaccccgggcgggctgaaggattccatcctccgcgctccgttatgggcagatgaaaaaaggccggaactgctcgtgcaggaaaacaacaggcgccaaggggaacatcaaagaccgaaaccggagacatccagaggaatggttaataaagatgtagaagagggcgacggtaatgaaaagacgtaaatggatacttatcctttgtacgatggtttcccttatgtttgtatccggatgctgggataaaagggagctgactgatttggctgtgatctccgccatcggtattgaccggaccgaaacgggaaaatacgtccttcacttgcaaattatcaatccgggaaacgtggccggcggtctgcagggcggcggagcgggagaccggcctccggtttccgtctattcggtgtccggagacaatatgacggaagctttgagaaaaggctcgatgaaagtgtccagaaggctctattttgcgcatacgaatctcgtggtgttcagtgaaaagctggcgaaagaggaagggctcagttttattcttgacaatcttgaccgcgacaccgaattcaggacgaccgcaaccgcggttatcgcgcataattgcaaggctgaagacattattaaagtgctgacgccgattgataaaatcccttccaataaagtgaacaagacgctcagcttcacgcaggaacaatacggcagagtcattaaaaccagccttcaggacgttctgattgatctcgcttctccggccgggtcgccgtttattccgggttatgaaatgcacggagacgataaagccggtcctacgatggaaaatacgcagacgactgaaccgaaagcagtgctgtcagcggacggactggcggtgttcaaaaaggatgggaggctggattactggattgaggatgacgacagtgtgggggctgtatggctgctcaataggatcaagcatacgttcatcaatgcggattggaagaatgtgaagcacgcaatcagtctgcaggtcacccgccagaatacaaaggtgacggccacttttccgaacggaaaaccgcatattcacgtgcatgctcaggtcgaggggctggtggacgctgtcagataccctttccatctgtctgatccgcaagtgctgatgacgatgcaaaaggcgctcagcgtgcagcttgacaaagatatcaccaaatcaattgaagatataaaagcccgtaagaatgacttcgtcggcttcggagacctgatctatcggaagcatccggacaaatggaaaaagttcaaagggaagtgggatgaagaatatttccccaatctccccgtagatgtcaaaacggaagtcattatcagaagaacgggcttgcggaataatcctctctcagacaagcttgagcatgattgatttgaggagaaaggagcgaagcgtatggaaaatgcgaaaatcggcacgcgtcagctgtttattatgatcattttgtttgaattgggcagttcgttattgattccgccaggcacgatggccgggcgggatgcatggctgtccgtgcttctcgggtgcgttatcggtctcggacttttctacgtttatcaggcgctgtatcaattttttcctgagtcttctccgagagattacatgaacgaactgatcggcagacatctgagctgggcggtctcgcttctttatattctctatttttcttatatcgcggcccgcgtattgcgggattttggcgaaatgcttgtcaccttcgcctaccaggacacgccgcttttaattgtgaatgccatgctgatgatcgccgcgatatttgcggtcagaaagggtattgaagtgatagcgagagccggcgagctgctgtttggcattatgtattttctgacagccgtcgggctgatcctcattatcagctcaggcacgataaacctcagatttctccagcccgttttagcggagggtgcaggaacggtcatttattccgtgtttaaacagacgatgttcatcccgttcggtgaattaatcgtgtttgtcatgattttcccttatttaaaagatcggaaaaaggtgaagaaaaccggatttctggcgattatcatcagcgggctgtttttggcgatgtcagtggcgattaatatttgtgtgctggacgtcaacttaatgctccgctctcaatttccgctgctgagcaccatacagacgattaaagtagaagagtttttagaccggctggatgtctttttcatgctcgtgctcgtcatcggcggttttttcaaagtcagcctttttacatatgcggttgtcgtgggtgtgtccacgctgtttaaagaaaaaaatccgtctcagctggcctttccggtcggattgggggtgctgattctctccatcagcatcgcaagcaatttttcggaacacatgaatgaaggcttaaacattgtgccgatctatattcatcttccgtttcaagtgctgttccccgttttgctgcttatcattgccgttattaagaaaaaggtcaaagggagcgtctatacagtttcgaagaaataacccggccgatgcgccgggttatttttaaaatcatgatttttgtcttaatgcattgacaaacttgcctgacaattgtacattttgatttattcttataaaattactaggaaatataggtttagtagtgttaatattttccgaaccgtatttcagaatagaaggagatccatcatgacaaagaaaaaagaaatcaaactcggtgtgtttctcgcgggcaccggccatcatgtcgcttcttggagacatcctcaggcaccggcggacgcgagcatgaatttggattatttcaaagaactggcgaaaacagctgagcgggggaaattggacatgctgtttttggcggacagtttatcaatagacggcaaatcacatccgaatgtgctgacgcgctttgagccgtttacgctgctgtcggcgctcgctcaggtcacatcccgcatcggtctgacggcgaccgcgtctaccacatacagcgaaccgttccatatcgcgagacaatttgcatcgcttgatcatctttccaacggccgcgcgggctggaatgtcgtcacatcttcgattgaatcgaccgcgcttaatttcagcggcgaaaagcatcttgagcaccatctcagatatcagcgcgcggaagaattcgttgaagtcgtcaaaggattatgggattcgtgggaggaagacgcctttatccgtgacaaagaatcaggagcatttttcgataaagacaaaatgcatgaattgaaccataaaggaacatatttctccgtgagagggccgttaaatgtcgcccgcacacctcaagggcgcccggtcattattcaggccggatcatcaggagacggaaaagcgctggccgccaaaacggcggaggtcattttcaccgcgcaaaatcatttggagtccgcgcaggaattctatcaatctattaaagaacaagcggcttctttcggccgtgatcctgaaaaaatcgcgatcatgccggggatatttcccgttatcgccgataccgaggaagaagcgcaggcaaaatatgaagagctccaagatctcatcattccgtctgtcggcctgaacattctgcaaaactatctgggcggcgtcgacctttccgcctgcccgcttgacggcccgctgcctgaattggatgcggatgcgtcgaatgccgttaaaagccggttcaagctcgttcaggagatggccaaacgcgataacatgaccatccgcgagctgtacaaatatgtggcgggttcaagaggccatcatatctttgtcggaacgcctgaacagcttgccgataagatggaagaatgggtcggaaaacaagcttgtgacggcttcaacatcatgccgccgcttttgcctgaaggtctcactctttttgtagacaaagtgattccgattttgcaagaacggggcgtgttcagaaaagagtatgaaggaaccacactcagagaacatttcggactggaaaaaccggcaaaccgatatgccgactaaaggagggctcatcatgtcaagacaataccggcttgcaacggaggcagacgctgatgagctgctttcactgacactgcgggcgtatgaaccgatccgcaagctcggcatcaattttgccgctgccacggcggataaagaactcgtattaactaacatacaaaaaaacgcctgttacgttttggaggaagacggacggattctggcgacgatttctctgcggatgccgtgggggccgaatcccgggccgtacggtgtccctcatatttggtggttcgccgtcgatcctgaaaccggaaaaaaagggacgggctcagacatgctggagtggctggagaacacagtgctccgcgatacattaaaagcgcctttcgtgtcactgggcacagcggacaagcatccgtggctgatcggcatgtacgagcggaaaggctacgtccgcgcaggcgaaaaggatttaggaaaaggccacatcaccatctatttaaaaaaacaattgcaggattaacattttaataggaaaaggcgggatttcaatgaagaagaaaacatgggctttgctgctgtctgccgcgcttttggcggtcttaacagcatgcggaaacggaaaagaaagcgaaggcggcgataacgtgctgcatgtcggcgctacgggacaaagctatccgttcgcatataaagaaaacggcaagctgacaggctttgacgtggatgtaatggaagccgtagcgaaaaaaatcaacatgaaactggactggaagctgcttgagttcagcggactgatgggcgagctccagaccggcaaactcgacaccatttcaaaccaggtcgctgtcacggacgaacgcaagaaaacgtataacttcacagaaccgtattcgtatgcgggcactcaaatcgtcgtcaaaaacgataacaaagacatcaaatcagtcaatgatctgaaaggaaaaacagtggcggccgttctgggctcaaaccacgcgaaaaaccttgagagcaaggacccggataaaaaaatcaacataaaaacatatgaaacacaagaaggtacgctgaaagacgtggcttacgggcgggttgacgcctatgtaaacagccgcagcgtcctgatcgcccagattaaaaagaccggtctgcctctgaaattagcaggagacccgattgtctatgaaaaagtcgctttcccgtttgcgaaagatgcggctcacgataaaatccgcaaaaaagtaaacaaagccattgaagacctgcggaaagacggcacgctgaaaaagctgtctgaaaagtactttaacgaagatatcacaaaggaagcaaagcaataagaaacggcggtgaaaatcgagaatgaacagcattgattggggatttatgttttcagcttttcccgcgttaatcgaagccttgccgatcacattactaatggccgtcgcggccatggtatttgccgtgatcggcggccttatattagcgcttatcacaaaaaatcgtattcctgtgcttcaccagctgtcaaaggtgtatatttcatttttccggggcgtgccgacgctcgtgcagcttttcttaatttattacggcctgcctcagctctttcccgggatgagcaagatgacggcgttaactgcggcgattatcgggctaagcctgaagaatgccgcctacctggctgaaatcttccgcgcggcgctcaactcagtcgatgaggggcagcttgaagcctgtctgtctgtcggaatgacaaaatcccaggcgtacagacggatcattttcccgcaagccgtcagaaacgcgcttcccgcgacgggaaatacgtttatcggcctgttaaaagaaacatcgctcgcttttacattaggtgtgatggagatgttcgcccaaggaaaaatgtacgcatcaggcaacctcaaatattttgagacgtatttagccgtcgcggtcatgtactggattcttacgattatttacagtgtgctgcaggatctgctcgaacgggcgatcagcaagccttatcgcacataggaggaggctcaggatgatacaagtcagacatattcgaaaagcatttaaagaccttaccgtacttgacgggatcgatcttgagatcaaaagcggcgaagtcacggccatcatcggcccgtcaggctcgggaaaatcaacgctcctccgctgtctgaatctgctggagcgcccggatgacggcatcattgaaatcggcgatgcaaagctgaatgcagcgtcctattcgcgcaaagacgtacacaagcttcgccagcagacggcgatggtgtttcagaattacaacctgttcaaaaacaaaaccgccctgcaaaatgtgacagaggcgctgatcaccgcgcaaaagaaaccgaaaaaagaagcggaacagatcggtatggacctgctgcggcaagtcggtttagaacacaaagcggacagctacccgattacgatgtcaggcgggcagcagcagcggatcgggattgcgagagccttggccgttgatcctcacgcgattttactggatgaaccgacttcagcccttgaccctgagcttgtagccggggtgctccaagtcatcaaatcaattgccgaaaaacagacaaccatgatcatcgtcacgcatgagatggcttttgcgcgtgaagtagccgacaaagttatttttatggcggacggacgcatcatcgaacagggaacgccggaggagctgtttgacaatccgcagaacgaacggacgaaaaaattcattaagcaagtgggagagcctgccgaacttgtctaagaagggaagaagaagaaatggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaactgcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcggcagggcagatcatcggcggcctgcaatcgattgtcagcagaaacatcagctcgcttcacaatgccgtcgtcagcatcacaagagttcaggggggcagttcttggaatgtcattccggaccatgttgaaatggaaggaaccgtccggacgtttcaaaaagaagcgcgggacgctgttccgaaacatatgaagcgggttgctgaaggaatcgcggccggattcggggcagaggctgacttccgctggtttccttacctgccgtcagtgatgaacgacgcccgattcatacaggcggcggaacaaactgctgaaagcctcggacttcaaaccgttcgggcagaacagtcgcccggcggcgaagacttcgcgttatatcaagaaaaaatccccggcttcttcgtctggatgggaacaaacggaacagaagaatggcaccatccagcctttacactcgacgaaaaagcgcttccgaaagcggctgagtttttcgcccggcttgccgtcaatgtattggagcagacggaatgaatacggaaaatctgacggccggacttgctcaggccgtcatgtcgtctgtgccggaaacatccgccgaagcgatgaaagaagcgcgcaaaggactgcttgattttacagcggctgcttttgcggggagacgggatacaggagttgaaaagctggtaaaactggccgaagaagaaggcgggatgccgatagcgccgcttatcggcagaaatcaaaaaaccacgccgtcccaatccgcgctcattaacggcttcatcgcacatgcgcttgattttgacgatgttcattctgatgtaagaggacatccgagcgcggtcatcctcccggctttgattgcagccgcatcagccggccggatagacaagagccgttttctcggtgcttatgtgacgggaatcgaagtgatggcgcggctcggcgagtcagctggaagggatcattacgagaaaggctggcacaatacaggaacgttaggtgccattgcggccgcatgcgccgtcggattcgcagagaatctgaatcaaacccaattacagaaagcaatcgggtttgcggctgcccgttccggaggcatgagagtgcaattcgggacagaaatgaagccgctccacgccggcctggccgctcaagccggcgtgttcgccgtaaagcttgcaaaggccggtttcggcggctcagctcatgcgctcgacggggagaaaggttttttcggactgtacggcgatcttgaacgggcagaaaccctgcttgtaaacgggtggggaaacccttggcggatcgtgagtccgggactttggtttaaggtttatccgttttgctcggcggcccatcatgcggcggacgccattctcaagctgaaggccgaacatggtctcactttcggccaaacggaacggattgacgtgatttatccgccgggcggggacgccgcattgacagaacggcgtccgaaaacaggcgaagcgggtcggttcagcgtagaatatgtgatcaccttagctttgcacggtaaggatttttcagttgaacatttcacatccgagccgattccgcaatcccttcaaaaaggatttgagcggattcaccgcagctgcgatgaccaaattcagccggctgacaacgccgttccgaagggccgttttacaattgtacgggtcacggtttccggcggtcatgtctatgaagcacgtatcgactgtccgaggggagcgccgggaaacggtctttctgaaaaagacattgaagacaagctccggctcgctttgccgggagaagagaaaaaggcggaagaattgatcaaagcagccggacaatcaaatattgaccgttatttacagctgatataaataaaaagagcgaggggatgcagccctggctctttttacgttcacttctattgaatagggggatatagggtgcgcccctgtctgcgctggcaggggcgcggtatcaggaaacggccgtgccgttttctttgaccgtgaaacttcctcttgataagcggatgttgatatcagacactttggcaatttgttcgtcgtgcgtaaccatgatgacgcatttgccgtctttatgcgccagatcctgaaagagccggacgatttcctttgacgtatcctcgtcgaggtttcccgtcggctcatccgcgcaaatcagatccgtgtcacagcagaaagcccgcgcaattgaaacgcgctgctgctgtccgccgcttaatgtcagcacccgctgacgggcctgctgttcggtgatgccgactttatccagcatgctgagcgcggacgcatctttgttgttctccttagatccggtaatctccatcgcggttgtgacgttctggagcgccgtcatatacgggatcagatgatgagattgaaagacgatagagacatattgatttctgaatttggttaatccgattttggagatgtcttctccgttataaaggatgcttccctctttaggtgtgtcaaggccgcccgccagagacagaaacgtggtttttcccgttccggaggcgccggcaattgtataaaacttccctttttcaaagctgatcgttatatcctgaaacagcggctgtgatttatcttggtaccagtagccggtctgttgaaaggttaataggctcattatgctgcctcctcttattcctgcttggtcaggattgttttagggtgaagccgcatgactgatacagacggcagtaatgtggcggtgacggcaattgcgacgccgatcccgccgagaatcagtaggtcattcagcgaaacgtttacctgcattgtactgatgacatctgcaccggatgaatgctgaccgaacatgccgtctccccgcggcatttctcctccgccccagccgcttgtttgctgctgggaatcatcggctgagctgacctgctgggaaagaagctgatttccgagctgattcgccacaaggctgcccgtgacggatgcgatcccgatggcgataaccgcgacaatcagaatttccgttaagaattgtccgatgagcttccagcgcttttcgccgatcgccatcaagacacccatttcatacttgcgttccctgatcgacatcatcacgatcaatccgagaatgaccgcgcccgcgatggatacaaggtacaccacgtttttagaaaatgacgcgacattttcaatcgggccggccatttgctgatacacctgatcatttgtcgtcagcgtgtaggttttatcatctatagatgtttttttcgcagccgcaacgaatgagtcaatatattttgcatcatccatataataaacggctgagctgattctgtttttgttatcagacccttttaacgccgcagctgcggtgtaaggcgtatagattttattgtcagggtttaagaatgaaaaatgctctgcctgatcgtctcctgatgatgttgttttataaattcccacaattttaagctttgtactcacagaatcatccgctgctgaggaaactgtaatggagccgccgaccttcagcttgttttgatctgccagcgtttcattgatcactgcgacttttgcgtccgcatctgtttttgtgatggcgcggccttcagtgatttttgagctcccgcctgtgaaatcatcaagcagcgccgtagagagcacgccttcgaccgaaatatccgctgaaatcatctgtcttccgccgccttgaaaacggcttccgccggagctgttatcggctgattcgcctgagctttttatcgcgtcaaagctttctgcgtttgctgacgctgtcgtgaggaagttgtaatttttaacgtgctgtaaagatgtaagtttcttggcatccgagacggaaatcggcgttgattcaaacgtcctcttttcaccgtctttttgctgctgcgccatttgcttttggcggtcagcctggagtgtgacgctcccgccgagctgctgccttgccagttcgcttgatttctttgccgctgactggatcgtaagaccggacaggacaaaaatgcaaatcactgaaaacacaaccagctgcaaaaacgtttttcccttttttgccttcatgctccaaaaggctctttttataaagttcatgtctgttcctccgtgtgggtgtcagatcttgtaaaaccagccttctttagaaccggttatccgatatgtatatagtaggagaaatgtatgaaaaaaatatgaacaaactatttccgggtgatgaaataaaaactaacaattgtgaaacgcgaaaatatccgggtaaaatggtgctattataagtaaaagcgtcaagataaacggaggacccaatgaagatattaatgatagaagacaatataagcgtatgcaccatgacggaaatgttcttttttaaagaaggatttgaagccgaatttgtccatgacggagtggaaggctatcagcggttcacggaagaggactgggatttggtcattctggatattatgcttccatctatggacggagtgacgatctgccggaaaataagagagacgagcagtgtgccgattattatgctgaccgcaaaggacacggagtctgatcaggtgatcgggtttgaaatgggagccgacgactatgtcaccaagccgttcagcccgctgacgctagtagcgcggattaaagcggtgatcagaagataccgggcgacggggcaggccgtaaaaagcggcgacttgatcgaaacggcgtgtttttcaatcaataagaagacgcgggaagtgtttctgcatggaaagcctgtcgagaatctgacgccgaaggaattcgatctgctcttttatctcgcacaaaatccgcgccaggtcttttcgagagagcagctgcttgagcaggtgtggggctatcaattttacggcgatgaacgtacggttgatgttcatattaaacggctgcgcaaaaaactgtccagtgaggaaaaaccgtttttatacacggtgtggggggtaggatacaaatttgatgaggattaaatacttatatcagctgctgttaagccatgtcagcattttgattttggcctttttcattatcatttccctgttttcgcactttgtgaaagattttgcgtatcaaaataaagtggatgagctgtcttcttacgcccagcagatcacaagtgagctgaacggacgcgatcttgatctgcgccgcctgtatccgtatcaggacatgttaaaaacgcgcgagaccaggtttattatttttgatgaacatcagcggccttacttttttcctgacgatatgccgccgcgcgagaagctcaaaagtaaggagtggcacatgctgaagcaagggaaaaccgttcagatcagagcggagatgaaccgttttaatacggagggcttggaagtatcgcttgtcgcaaaaccgcttttgatcaacgatcaatttaaaggcgcggtgctgctcgtgtctcccgtcagaggggtcgagcagatgatcagccaggtcaaccgctatatgatttacgcgattatcagcacccttatcatcacgattctgctgagctggcttttatctaaatttcacgttaagcggattcagacattgcgggatgcgaccggaaaagtggcatccggggattacgatatttcgctcaagaacagcggcggcgatgaaatcggcatgctggcgtccgatttcaacatcatggccaaaaatctgaagcaatcgagagagcagattgaccgcctggaaaaacggaggcgccaatttatcgccgatgtctcccatgagctgagaacgcctttgacgaccattaacggacttgtggaggggcttaacagcaacaccatcccggaaaaagataaagagaaatgcttctcgctgatcagtgaagaaacgaagcggatgctcaggctcgtgaaagaaaacttggattatgaaaaaatcagatcccagcaaatcaaactggacaagctcagtctgccgctcatcgaggtgtttgaaattattaaagagcatctcaatcagcaggcggaggaaaaacaaaatcagctgcggattaaggcggaggacggcgtcaaagtgttcgccgattatgacaggctgatccagattctcgtcaacatcacgaaaaacagcattcaatttacgcaaaacggagacatcacgctgcgcgggtatgaaggctataaagaaacggtgattgagatcgaagacaccggaatcggcatctccaaagaggaaattgagcatatatgggagcggttttataaggcggacgtgtcccggacgaatacggcatacggcgaatacggactcggcctgtccatcgtcaggcagctcgttgaaatgcacaagggcacgatagatattgccagcgaaaaaggaaaaggcacgacgtttacaatccgccttccgctgaatacgatacatgaatcatcttgaaaccggcagtcccgtctggctgccggctgttttatcttcactcggaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaaaattaacgagtggtatcgatacatcagaacattcagcgtgccggatgcggagatcttgaaggccgagatcaaacaagagcttgaccgtatggagcctgattcaaacttagtgctttattattccctcatggaatttcgccatcagctgatgctggactacttggagccgctggaaaaactgaagatagaagaccagccgaccctgtcggaaattcttgataacattgataacagccaggccggcctcaaagggcttctcgattattacgtcaactttttcaaaggcatgtttgaatttgataaaagagaatttatctcagcgattacgtattataaacaagctgagaaaaaacttgccttcgtatcggaccacgtggaacgggcggagttttattttaaagtggccgaagcttattatcatatgaaacaaacgtatttttctttgatacatataaaaaacgcttatgaaatttacgtagagcaggacacatataacgtcaggatcattcaatgccattttgtattcggcgtcaatttaatggatgaaaggcgctttgaacaggcggccaaacattttcagcacgctctgcaaatggccgaaaaagaacaaaaagcgcagcttgtcgggagggcgctgtataacctcggactgtgctactacaatcaggaccgcatcggcgaagcgattccgtactttgaacgggcggttgatacatttgaatcacaaagaatcgtcaattctcttcctcaagcatatttcctaatcacactcatttactttaaactcggaaaaaaagaaaaagcgtcggaatatcacaagcggggatatgaatatgctaaagaaacagacgatcccgtttacacggtaaaattcgaatggctgcaggctctgtatcaggcgaaaccggatgaggaaacaatcagcgcatgtttccgttacctggaagataaaaatttatacgccgatatagaggatttagcactagaagcagctaaatattactatgaacaaaattgctttaagatttcttctgactattttctgaaagtcgaagaggcaaggaaacaaatacaaaggagtgagggtttgtatgaaattgaaatctaaatggtttgttatttgtttagcagccgccgcgatttttacagtgacaggtgcaggccagacagatcaggctgaattccatgtagctgaaagaggaatgacgtgagaagaaaataacctgaacaaaggaaaagactgcccgggaatgttcccggcagtctttttttttttttgcgcggccggacttggacagcggcggaaaacaaaagaaaacgccgcaggtcaaaacccgcagcgtcctcatatagacggagtgatgcttagaaaccgccaacataggcagtacctacaataaccaacaggataaataaaacaacgatcaaagcgaaagagctgattccagaatatcctgacatgagcttcacctccatattgtctataccatacaatatgtaaaagaagctgctttgtaagggatattagtggacaagagaaaaaagaggcggtgtcctatgagagtaagactcctgcaaaaaactcgtcatacagcgcccgcaccgcttgtttttcctgttcttctttcaccccgaacatcatgctgacttccgatgacccctgattgatcatctcgatgttgacgccggcttcggacagtgctttggatgccctggcggttgtgccgacattatggcgcatcgcttccccgacgaccataatcagcgccaggttgtgcctgactgtgacttcatctgcttgaagttcctgcttcagacgggtgacgagcctgtgttccagttctgagtccatctgatcgtgccgaaggatgatcgtgatgtcgtcaatgccggatggaacatgttcatacgtcaatccttcttcctccaaaatgtgaagggctttgcggccgaaaccgatttcccggttcattaaatatttgcttatgtaaatgctgcaaaagcccgtgtcgcttgcgatgccgatgactggcccgttcgtattgtcacggctgctgacgacgcgcgttcctttcgcctccggattattcgtattcttaatctgaacggggatgccggcccgaaaagcgggaatcagcgcttcatcatgaaaaacggaaaacccggcataggagagctcacgcatttcccgatacgtcagttcgttaatttctttcggatgccgcacgattgacgggttgacggaatagacggcgtccacatcagtaaagttttcgtacaggtcggcttttaagccgctggcgagaatggagccggtaatatcagaaccgctccgggaaaacgtcacaatctcatgctccttcgtgtaaccgaaaaatcccggaaaaatgatcaagccttcacggtttctcagacggtacaaatgatcataagactcagggagcacctgggcgcttccgggttcattcgtcacaaacagccccgcttctttcgggcttacgtattcggctttcacgccctgccggcggaagtaggccgcgatcagcttcgcgttgttgtcctcgccgctcgctttcaccgcatccatatactgatcgggattggctttgctgctgtttaagagagcgaataggtcactgcggattctttctataatagagaaatccaggttcagctcacgcgcgatggcggcgtaccgttcaatgaccggttcggcaagctcgggcgctgcacctttttgcaaataatgctccgcacagcggattaacagatccgtcacctttgtatcgtccgagaagcgttttcccggcgccgatacgacgacggctttccgcgagggatcagccgtcacgatttgaaacactttctcaagctgggctcctgacgcaagagagctgcctccgaattttacaactttcatgttttacatcccctaatatttaaattttctcacaaatttaatttttattatctctctttcaaacatgtaaatcaaggattttttctatgtggggagaacatttgtattttcatggaggaattttgacgctgtttgtcagatttgtttcccgcaagcgtgtcatcatgtgcaaaaaatgataagcagccaaatgaaggttatagaaaatcctgcaaattcttgatagactgattgtaagacaatttagtgtacggcccgcggatgaccgtttttgaaagcaaaactgtattgactgcgcttggaaagatgataagattatagttgtcgttgataatgataatcattacgagtggggatatatgggagttgtttggcaatcagtcataccgtttgtgatgggtgcagggaggcagcatgaagctacgttacttacttttgctactggcggttttggcgtgtacttctatatttatcggtgtagaagatttgtcgccgctggatatttttcatttaaataaagaacaggcaggtacattgtttgacagccggctgccgcgtttggtgagcattatcatcgccggcatgagcctgagcatctgcggattaatcatgcagcagatcagccggaataaatttgtatcgccgacgactgcgggaacgatggactgggcaaggctcggaattttgatttcattaatgctttttacgtcagcgagcccgcttgtgaaaatgtctatcgcttttattttcgcgttggcgggaaatttccttttcatgaaaatcctcgagagaatcaagttcaatgatgcgatttttattcctctcgtcggtttaatgcttgggaacatcgtcagctcaatcgccacgtttatcgcatataaatacgacctgatccaaaacctgtcatcttggctgcagggagatttctcactggtcgttaaaggccggtatgagcttttatatctgagtatcccgctagtgatcatcgcttatgtgtatgcggataaatttacggtggcgggaatgggagagagcttttccgtcaatctcggcctgaaatacaaacgcgtcgtcaatatcggtctgattatcgtgtcgctcatcgcttcactggtgatcctgaccgtcgggatgctgccgtttctcggtttgatcattcccaatatggtgtcgatttacaaaggggacaacctgaggagcagcctgcctcacaccgctctcttgggcgctgtttttgtgctgttttgcgacattttgggaagggtgatcatcttcccgtacgaaatttccatcggcctgatggtcggtgttatcggcagcggcatcttcctgtatatgctgttaaggagaaaagcatatgagtcataataaaaaaattacgctgctggcggcgctcgccataatatgtatcggattctttctgttctacggactgggcaattgggaatactccctgccgagacgatgcttcaaagtgcttgccatgatgctcacagggggagcgatcgcgttttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaatcttaatttcgtcatctccgtcggactgatggtgctcttgtcactcgttttgtatcagctcatgtttaaaggcgaggggcggaacgtgtttttccttctgcttgtcggcgtcgtgttcggcacgctgttcaacagtctgtcatcctttatgcagatgctgattgatccgaatgagttccaggttgttcaggacaaaatgtttgccagctttaacaatatcaacaccgatcttttaggatttgccggtgctgtctttcttctgacaggcatttatgtctggcggttcacgcggttttttgacgtgctgtcgctcggcagggagcacgccgtcaaccttgggattgattacgataagcttgtgaaacagatgctcatcgtcgtcgccattcttgtgtctgtctctacggctcttgtcgggccgattatgtttttaggactgcttgtcgtcaatctggcgagagagtttttaaaaacctacaggcacacgtatttaatcgcgggttccgtcctgatcagcatcgtcgcgctcgtcgggggccagttcgtcgtggagaaagtgttcacgttttccacgacgctgagcgtcatcattaattttgccggcgggatttattttatctatctgctgttaaaggagaataaatcatggtagaggtcaaaaatgtaagcaaacaatacggagggaaaaccgtccttgagaaaacgtctctatccattcaaaagggcaggctcacctcgtttatcggtccgaacggcgcgggaaaaagcacgctgctgtctatcatgagccggctgattaagacggattccggagaaatcacggtcgacgggcaagagatcggggcctgtaaaagcaacgatctggcgaaaaaaatcagcatcctgaagcagacgaaccaaatcaatatcagactgacgattaaagacctggtcagcttcggcaggtttccgtattcccaggggaaactgacggatgaagattgggtgcatatcaaccaggccctcagttatatgaagctggatgacttaaaggataaatacctcgatcagctcagcggaggccagtgtcagagggcgtttatcgcgatgatcatcgctcaggatacggactatatttttctcgatgagccgctgaacaatttagatatgaagcattccgttgaaatgatgaagctgttgaagcggcttgtggaagacttcggaaaaacggtcgtcgtagtgattcacgatatcaacttcgcatccgtatattcagaccatatcgtcgcactgaaaaacggacggatcgtcaaagaagggccggcggaagagatcattgaaacctccgtgcttgaagatatttatgatatgaccatcccgattcaagagattgacagtcagcggatcggtgtgtacttttcttaaaaaccagatgaggtgaaagtcatgaaaaaattcgcattgctattcattgcgctagttacgatttttgttgtttctgcatgcggaaacggggacaaaacatcaggcaaatcaaaagaaacaatcacaatcaaagatgatctgaacaaagaaggagtcaaagtgccgaagaatccgaaaaaagtcgtcgtattcaacttcggaatgctggatacgatggatgaactcggtttacaggatcacgtggcgggacttccgaaacaaaaccttccaaaatacttatcttcatataatagtgataaatacgccaataccggcggtttaaaagaaccggattttgaaaaagtcgcggatattgatccggatttaatcattatcgcccacagacaatctgattcttataaagagttctcaaaaatcgcgccgacgatttatcttgatgatgactatacaaactacgttgacagattcaagcaaaacaccgaagtgatcggcaaaatctttaacaaagaaaatgaagtgaaagataagcttgcgaaaattgacaaatccattgccgatctgaagaaaaagacaagcagcacggataaaaacggattagtggtgatggcgaacgacggcaaaatcagcgcgttcgggtctaaatcaagatacggcttcattcatgatgtgttcggcgtcaaaccggctgacaaaaacatcgaagcctcactgcacggacaaagcatttcctatgaatatatcgccaaaacaaaccctgattacatgtttgtcgttgaccgcggaacagcgatcggcacaaaatcttcaacaaaacaagtggttgaaaatgattatgtaaaatcggtgaaagccgtgaaaaacaaccatgttgtctaccttgattcagctacatggtatttatcaggaggcggcctggaatccatggcgcaaatggtgaaagaagtaaaagacggaatcgagaagtaaaaaaagaacccggtcacatacgtgatcgggttctttttggtttaccgcgtaacggcctgctgctgctcgggctgacgcggttttttcttcaatgtaaaagataggaggaagccggccagcgcgatgcaggcggctacgacaaaggccgcattcatgccgtgcagggcggcgtttgccggagttgacgcattggcgtgcgcggcctggctgctcatcacggaaaccagcagcgccgtaccgatagaaccgccgacttggcggacggtattgttcatggctgtgccgtgcggaattaagtggcgcggcagggcgttgattcccgctgtcgtcaccggcatcataatcatggctgttcccaaaagccgcgcggtataaacgacgacaatccaaatgagagacgtcgagtccgtcagattcataaacggcagggacgtgagcaggatgatgaagaatccggtcatcgcaaggccttttccgccgattctgtcaaacacccggccgataaacggagacatcatccccatcacaatcgcgcccggcaaaagcattaatccggtatcaaacgcggagacgccccggactttttgcgtgtaaagcgggagaatggtttccgttccgatcagcagcgcgaaaacaagcgttccgagcagggtggtcaggctgaaaatcccgaaagaaaacacacggaattccagcatcggttttttgagcttcatctgtcttgcgataaagaaaatcagcgcggccgctccgacaagcagcgaagtcagcacttcagtactggtccatcctgaggaaccggcgcttgagaagccgtaaagcagcccgccgaatccgagggtcgataagatcacggataaaatatcaatctgtgtttctcgtaatgtcgtgacgtttttcatcagaataattgctaaaagcaaatcgatgactgcgatcgggaagatgatataaaacaaagaccgccaagagaatgcttcgaccgcccatccggaaagcgtcgggccgatcgccggcgcgaacgaaataaccaagccgaccatacccatggcgcggccgcgcttttccatcgggaaaatcgtgagaaataccgtctgcatgagcggcagcataattccggcgccggccgcctgaataatccgggccgttaagagcaccggaaagttcggggcgaatgcgccgacaatggtgcccgccgtgaaaatactcatagcggaaatcaggagggtgcggctcgtaaatttctctattaaaaatgcggtaatcggaatcaaaatcccgtttgtcagcataaacgacgttgtcagccattgcgctttgttggcatctatattgaagtcattcataatgtgcggcagcgccgtgataagcagtgtctggttcaaaatggcgacgaacgctcccgccaaaagaatcccgacaatgacagagcggttgtatggtgcagttttaatactcttattcaagctgattccttctttctttatagtttgagcaatgttttaacggctgcaagcggctggtgcagcggtccggcctgctccaaataaccgatgagcgcttttataagaaaatcccgcggctgtttgtccgctgattctttctccagcataaccgccgcggaagcgagtcctgcggcatcatatttttcctccggaagggctgagacggcttctttcagttccttcaggctttcagccagcaatacggttttgtcttttggctcaaatgaggaagcggaggcggtataaaggtcaatcatctcctgaggcaaagcggtttcggttttcctgttttcgacgatgagattgagatggcggatgataaagtccgtgagcggctccagggcgagcggttctttttccagcttaatcagcgtgatgcattctctcaggagcccctgcaggacgatcaccagctcccatacataaggaataatgtcttcgccgtacgtctgaatcagtgaatcgcgatgccagcagataaaggtggagcgggccctgtgaatatgccgttttacccgctcattaatggaagaggggcttccgtacatcagcatattaaaaaactgctggttgcgcctgaagccttcaagctcagccatcagttttttggcaaaccgttcctcaggggagaggctcgtttcttcatttaataatgaagcggccgctaccatctgtttctggttaaaatcgagcagctccaggagcaggtcttcctttgattcaaacagcttatacaaagatgctttggagactttgcactcctctgcgatcgcctgcatcgagaccgacgaaaagcttttcccggaaaaaagcttccttgccgccagcagaatatccgttttcttatcattcataagcccagattccttctttcgtcacaatagaaaacccatcggttcacagaaaaccaatgagtatatgatgaaaatattaacaaaaatttttacatagtgtcaacgcttttgtttgagaaatagaaaaaacctgccggagtgttccgacaggctgatacgtttatttatccgtcttaaatccttgtttttcaagcatttcacgaatgtgaggataataaacctgcttatagtaggaagtgatgccttgtgaccagtttcttgtttcctgtccgtcggtgcgttttttcatgtattcggacatctgcttgtcataggcctcgatatgggttcttaaatcttcttcttgatacgtttcatgatgcagaacggctgcttgcggcagacgcggttttttcgcggagcggtctgccggatggccgatgacgagaccggaaatcgggaaaacgtatttcggaagtttcagcaattcaatgatttcgtcaggcttgccgcgcacggcgccgatcggcacagtgccgagtcccattgattcagccgcagccgttgccgtacccagcgcaatcccgacatctacggctccgactagaacggactctagaccgttcgtgatctcaagcggtgtatcattatattcttcaagcgcaattttagcgcggttaaaatcagcgcagaataaaaggaaaacaggcgcttggtcaatccacggctggccgccggccaattcggatatttttttcttccgctccttatctttcaccgcaataacggtaaattgctggccgttaatggaagtcggcgccgcctgagttgcttggatgataaggtccagctgctcatccgatacgggttcatctgtgtagctgcggatggaacggtggtctgttaatatttgaaggacttcgttcatgtcattcatcctttcgttactctgacagttctgtgcggacgacgtcaagcggcgcactcagcacttcttttgcttttgctacgaatccttggaaatggtcagttgcgttgtggaatttcatcgcttcttcatctttccattgctcaagcataacgaatgtattttcctcaccgactttttcgaaaagatcgtattgcacatttccttcttccgcgcgtgaatgctgaacaagtgattgcgcttctcctaaaaattcctcgcgtttatccgcttttactttcatgtaagcctgtaagacgatcattgttattcctcctgattgggtttatttgttatagttcgaatattatcgaactaactgtaacatgtttcgcagtgaatggtaaaggaaaaaccctcaccgcctaaattgtcacccgccgcttttatgtgttacatttgactcatgaacattccaaaccatcctgaaaccgaccgcttacagctgacaaaggttcttcatgctctgagtgatccgctccgcttagagctggtcaaacaattggcggaaacaacagaaaaaacgtgcggtacctgcgctgatgtccgggtcgccaaatcaacgctgtcccatcacttcaaagtgctgcgggaagcggggatcgcccaagtgcgcatagacgggaagcaccgttattattccctgcgcaaagatgatttacaagcggcgtttcccggcctgctggaggcgattttgcagacagaaccggaccgctggtaaataagtccccgaattccggggttttttttatgcgccgaaaaccgcccggtaaagcctgaggacgccatcttgaatatcgctctccttcaggcgggcgaaccccagaatgagctgcggcttatttgaatcgcctcccgctttcagacggaaccggctcatcgcaaacagatcgagctgttctgcatccgcccgtgccaaaatctctttttctgaacgggcgcagtcaaactcagtgacaaaatgaagccccgcattggcgccctttacactgattctttctccgaatgtttcttccaaagccgaaatgaggcgttcccgcatgttcttataatgctgcttcatctttttaatatgtttctgatattcacctgagtcgataaattctttcagcgcgagctgggcaagcgtgctgcacgtatgcaggtcatacgttctctctttgaacgtccgcaaaagcccgggcggcagaaccatatagctgatgcgcagacctgggaaaagggattttgaaaaggtccccatgtagatgacattttgaaaccggtcaaggctttgaagcgccggtatcgtatcggcgtcatatttaaattcactgtcataatcatcttcaatgatgaagcggccgttctgttcggcggcccagtttaaaagctgaatccgccgggaagcgggcatgatcacgcctgaggggaattgatgggaaggcgtggtgatcaatacacagggccggcgtttttcgatttcggccatggacatgcctttttcatcaaggcagatcgtcgcaacctttttcccgaggttttgcagcagccgatacatcctcatatatcccgggttctccatggcgtacagcgcgtcttttggcagcagttccgtcagcagctgcatcagcatttgcgtgcccgccccgagcacgatttgttccgggcggcatgtaacgccccttgtcagggaaataagccgcgaaatggtttcacggacttcatataagccttgcggatggacgaggtctccgagtgtataaaatgaacgggcggctgctttatgctcacagcggaaccagcttttcaggggaaaatgcgccgtatccacgctcatatgagaaaacgaaatccagccgctcttatccggctcccgctcttttaaatcttcaggcaatgagagcgaaggcgtttcttcatgataaaccgtatcaatttcctccacgaaaaagccttttctttcgactgcatataaataaccttccgaaagcagctgctgataagctgaattcactgaattcacgctgaccttcagcgtctcggcaagctcccgtttagacggcacctttgtatgaggcatcaggctgcgtttcaaaacggccgcttttatgtgctgatagatctgctgatagatataatccgccgtttccgaatggtcaatggaaatcgtcagcatccagaccctgctcctttctgataccatggaaaaattgattttggtacttttcatcataccaaaaagaagtcagaatgataagaaaacaatgcagggggatggaatctatgagtcgaacagcatcatcggaagtgacaacagcccagtggcagcaaaaacgggatcaattcgtttccaagggggtcggcaacggaaaccgcagcatggcggtaaaaggggaaggggcgcttttgtacgatttggacggcagacgattcattgattttgccggagcgatcggaacgctgaatgtcggccattcccatccgaaagtggtggaggtcgtgaagaaacaggcggaggatctgattcacccgggatttaacgtcatgatgtatccgtcttatattgagctggctgaaaaactttgcgccattgcgccgggagatcatgcgaaaaaagcgatttttctcaattcgggggcggaagcggtggaaaacgccgtgaaaatcgccagaaaatatacgaagcgccaggctgtcgtgtcatttacaagagggttccacggccgcacgaacatgacgatgagcatgacgagcaaggtgaagccttataaattcggtttcggcccgtttgcctcagaggtgtatcaggcgccgtttccttactattatcaaaagccggccggcatgactaacgagcagtatgacgactttatcatcagcgcttttgaggatttctttatcgccgcagttgcaccggaaaccgtcgcctgtgtcgtaatggagccggttcagggagaaggcggcttcatcattccttcaaaacgtttcgtgcagcacgtcgccgctttttgtaaaaaacacggtatcgtttttgtagcggatgagattcagaccggttttgccagaacgggaacgtattttgcgattgaacatttcgaagccgtccctgatttgatcactgtgtccaaatcacttgcggccggattgccgctgagcggcgtcatcggccgggcggaaatgcttgatgccgccgcgccgggggaactcgggggcacatatgcgggaagcccgctcggctgtgcggctgcgctcgcggtcttggatattattgaagaagaagggctgaatcagcgttccgaagagatcggccggatcatcgagcatcaagcgctcgagtggaaaaaagagcatgcctgcatcggagaagtgcgcagactcggcgcgatggcggccatcgaaattgtcaaagatccgcacacgcgggaaccggacaaagcaaaagccgcggcgatcgctaaaacggcgaacgagaacggactgctgctgctgacggccggcattaacggcaacattatcagattcctgacgccgcttgtggtgacggatgagcagctcaaagaaggcctttccattatcgaagcagctctgtgagttcaattattggaatgccgccggatgtgtctgctatcatgaaagtgtgagatacatcaacaagcattcaatggttttactataggaaagaaaggaatgttcaatatgccagaacaattaacagtgtacaacccggcaacgggagaggcgatcgaaagcatcccccagcagacggccgaagatgttgaaaaagcgattgaacgttcacatcaagcgtttcaatcatggtccaaaacatcagcgggagaacgtgcctcacttttgagaaaatggtatgagctgattgttgaaaataaagaagaacttgcggaattaattacgaaagaaaacggcaaaccgtacgaagaagcggtcggagaagttttatacggcgccggctatattgaatggttcgccgaagaagcaaaacggatttacggcagaaccgtacctgcgccgacaacgggcaaacggattgtcgtcacccgtcaggcggtcggcccggtagccgcgatcacgccgtggaatttcccgaatgcgatgattacaagaaaagccgcgcccgctttggcggcaggctgtacgttcatcatcaaaccggcggaggatacgccgctttccgcttacgcccttgcgcgtctcgcatatgaagcgggaattccgaaggacgtgctgcaagtggtgatcggtgacggagccgaaatcggaaacgtcttcaccagcagcccgaaaatccgcaaaattactttcaccggctcaacgcctgtcggcaaaatcctgatgaaaaacagcgccgacaccgtaaaacatatgtcaatggagcttggcggacatgcgccgctgatcgtggatgaagacgctgatcttgatctggcggtagcccaaacaatggcctctaaattcagaaatgccggccaaacctgcgtctgtgcgaaccgtctgatcgtacatgaatccgtgaaagacgagtttgcgaaaaaactgagtgaagaagctgcgaaactcaaagtcggaaacggtcttgaaaaaggcgtaaacgtcggccctgtcatcaacaaaaaaggcttcgataaaatcgtcggccaaattaatgacgccgtggaaaaaggcgcagaagtgctgacgggcggaacgtatgaccaaaacgatgaaaaaggatgctatttcgtgacgccgaccgtgctttcaaatgtagacacatccatgaacatcatgcatgaagaaactttcggcccggttgcgccgatcgttacgttctcagatattgatgaagcgatcaagcttgcgaacgatacgccgttcgggcttgcggcttatttcttcacagaaaactaccgccgcggcatctatatttctgaacagcttgaatacggcatcatcggctggaatgacggcggtccgtccgcggttcaagcgccgttcggaggaatgaaagaaagcggcatcggccgtgaaggcggtacggaaggcattgaaccgtacctggaaaccaaatacatgtctatcggactttaatgagccgaaaagaaagccccgcttctaagcggggcttttttattgagcggtctgccggtgaatatcgccggcaggcttttttgatcttgcgggaataatcggttcgattccagacaaaataacagcaaatacgattgaaagaaggtcgccatcatggatatattactggctcttctcccggctttattttgggggagcatcgtgttatttaacgtcaaattaggcggcgggccttacagccagacgctgggaacgacaatcggggcgctcatcgtttcgtttgtgctgtatctgtttgtccatccggtgctgtccgggcgcatttttattgtcggcatcatctcggggctgttttggtcgctcggccaaagcaatcagcttaaaagcatacagctgatgggcgtttcaaaaacgatgccgatatcaacgggaatgcagctcgtctcgacttctttgttcggtgtgatcgtattcaaagaatggtcaaccccgatcgcgattacgctgggtattctcgcccttatttttatcatcatcgggattgtgctcacatctttagaagataaaaaggggcgggcggacggagaaccgggaaacttaaaaaaaggcattgttatcctgctgatctccacgctcggctatttggtctatgtcgtcgtcgcccggctgttcggtgtatccggatggtcagcgcttctgccgcaggcgatcgggatggtcatcggcggactgctcctgacgtacaagcataaaccgtttaataagtacgccatcaagaacattctgccgggaatcatctgggcgctcgggaacatgtttctgttcatctcacagccgcgcgtcggagttgcgacaagtttttccctctctcaaatggggatcgtcatcagcacgctcggcggaatcttcattcttcgtgagagcaaaacgaagcgtcagctggtcgccattgccatcgggattatcctgatcattgtagcggcggtattcttaggcgttgcgaaatcaaattcataacatatgcaggaggtttgaacatgtacacggatttaaaaggaaaagtcgttgccattacgggagcttcatcaggattaggaaaagcgatggcgatccgtttcggacaggagcaggcgaaagtcgtcattaactactatagtaatgaaaaagacgcccaaaccgttaaagaagagattcaaaaagcgggaggcgaagcggtcatcgttcaaggagacgtcacaaaagaagaagatgtcaaaaacatcgtgcagaccgcagtgaaggaattcggcacattggatgtcatgatcaataacgccggcatggaaaatccggttcagtcgcatgaaatgccgctcaaagactggaacaaagtcatcaataccaatctgaccggcgctttcttaggaagccgcgaagccattaaatattacgtagagaatgatattcaaggaaacgtcattaacatgtcaagcgtacatgaaatgattccgtggccgctgtttgttcactacgcggcgagtaaaggcggtatcaaattgatgacggaaacgctggcgcttgagtacgcgccgaagcgcatccgtgttaacaatatcggaccgggcgccatcaatacgccgatcaacgcggaaaaatttgccgatcccgttcagagaaaagatgtggaaagcatgattccgatgggatatatcggtgagccggaagaaatcgcggctgtcgccgtctggcttgcttcaaaggaatcaagctatgtgaccggcattacgctgtttgctgacgggggaatgaccaaatatccgtctttccaggcaggccgcggataagaaaaaaagcgatcgcaggctctttagagccggatcgctttttgcttacacacgttttttctttacaagcgccgcgatggaaaggataattgccgcagctgacagaacgatggctgcaatatcaagcgctgatacgccggatttgctttcttcgtttgactgttcagctccgtgcgcatccgtcacgctcgccgatttcgtgattttcgtaatcgagtgaggcgtgtcggctttctcatcacccgtccattctacaatgctgccgtctttgtaatattggtaagcgtcccaagcggcatctccgctcttttcaggatttttcgcaacgaacgtgaactgctggaattggccgggctgaatgccgccgtcctttgcttcccaagtgacggagaccgctttgtcatcatgtttggatacggatgttttccagcccggaatcggctgatactgctgaaattcaacgccggcgggcattttcagcacgactttcgttgtcggctcattcttttccacaggcactttcatcgtgtacgtttcccaagaaccggccgcggattccgcgggtttgactgagacgtgggcgcttgctgcagccgtaaaaccgacgagtgacagggtcacggcggatatgaatattaaagccttttttttcaacatgagatacactccttagtttgtcgttgagaatatttggttgatttcattaaaatcgtttgtcagtccgtggactttgatcttccagtttcccttttcggtgatggacaggttggcggcttcgaatgtgccttccttcgtcttcttcaaatcaaaggtgctttcatgctgtttgccgctgaagcccgtctggtaaacagtgaccgtaaattgctgaatgtcttttactaagctgccgttatgatcggtgacaatgacttgaaattcatttttacccggctggttcggcgtaatgtgcaaggatagggtttccccgtttccgatcgtttctgagccgttaaaaggcaatggcgcgggcggaggcggactgggcaggcttgtgaagacggcggttgtgaataacaccgcaatgcctagtgcccattcggcctttatcgttgcgctgatgctcctttttctgctgaacttcgtcatccatacgtgaacggcgccgagcgcaagcatgatgacaaacagtccgattttcaaaaggagcgtcttgccgtaagcggtgtgaaagagtgaatcgaacgagcggataatgaaaaatccattcagcactcctgaaaataacagcacgccgacagaggcgaacgcccaaggagaaaaccgtctgaccgtttcccaagcgatggttttatcgggttctctccactctgatgaaagaagcagcacaagcgcggcgataccgcccatccatacagacgcggccgataaatggagaaagtccattgcgatgccgaccgctttttcgtcgataacggccgcatgcccggcgaatgcttttgccaaaagcgaagcgaagaagaataacagcggcgccgtccagtacgcaaatgaccggaatgctttcttcttcagcagcgggatcatggacagggcgagcaggataaataagctgatctggatcatccagacgtacccgcctgccgttttcagaagcgtttcttttacatagtccggctgaaacgcggcgctccaagcgccgcccgcgttttctttcgtctggatcgggagctggcacacgagcgcgagccccgttaaacataaagaaatcacgagcagctttacagttcgttttgcttttgatgaatcttcattatttctgtaccaaaacagatggaaaaaagccgtgccgataaacagggagagagcggtgtacaaaataccgcggtcgatggccgcttcgggatgaagcgccgcttgcgatgatgtctgctcctgaagttctccgccggcttttccgatgctgaaagggatgacgccggataccggatgtccgtcggccgataccgcgttccattccgctctgtaaatatcatgcggcagattttttttcaatgccgcggtcatgatgcgggcattatttttttgaatcaccgttttgcccgcgtcaacccgttcaccggatgaattatagaccttaatggagtggaagccttcttcaatctgttcattaaactcaatttcaatctgcttcggcgcttgttttaattcgctgttctcacccggatttgagtttgtgatgtaggcgtgggcgaagcttgttttcggaatcaaaacaaggaacagcaaaaagacgagccagcgtttgttctgtctcatggatgatgacaccgccttccggttggttgttgttatgtcttgctgcaggtgcatcccttctgcctgtcgtgtaagatgatgtccgccgcctcgtcaaaggtgcaaatgaccccgccgaatcctttttgaaaccgttctgcgtaatcaagcgttgagaagggaatcgcctgaggccggcagcagtgaaggtcaatatcggcatggactaaaaagtatgcggaagctgccgttagcgtcgtctgaagaagaaaatccttacaaatgacgtgggacacttcatcctttttatcctcataccgcaaaatcgcgcaatgaatgcagcacatctgctcaacggtttgtgaaacggtaataagctgaacagaatacgaatgctgaatcggccgcaggcaatagccgcattgattggcgcttcgttctgaagcgggagggagcgtaatgccgccgggtgtccggataatccggtttgcatccgccagctgattgacgtctctgtacacggtcatctcggagacgccgaatctctcgcttatgtcagagattttcagcgcgccctcttctttcagccattcaagcaaggtttgctgtctgtgaatcggaagcaattctgcatcctcctttttatgcgaatgagtgatgaacctccctctaagagtagatgttttcacaaatgcacacaagagcctgatgataaaatatgtgaaaaaatgttgaacaatcacaaatgtaaaacacgcagtcagactctgttataatagaagagttgaatggaggaataaacatgaaagaaacgacctgcccgaactgcggcaagccgattacaggcgacatggtcagatcatcgatgatcccgtgccagtttcagtgcgggcattgccatgtgaaattgcgtgaatataaagtatcagctccgattatggctgcggctattgcgatcacggtgcttttgatttatcttgtgcagatggccagaaccgccgtcatgccgatgtttccggcagcgcggtatgtgccggccgccattttcgcgctcgtatgtgcgtatccggtgtttattgtcagtgagcggctcattgccaagctcgtcgtcacaaaaggacacattatatacagaaagcggtaagacacctttgatgaggtgtcttttttttgttaaggatttgtcacagtctctgtgccaaactcctctttacttttcattgaatggggattgtaagcgttttatgatgaagacacaggggagagagaaaccccgtgtcttatttattttcatctgaaggcaggcaaacagggagggaatgagcatgcagcaagaacagcaagctggcatgaaagtgaagatacagcggttcggcagttatttaagcggtatgatcatgccgaatatcggcgcatttatcgcatggggaattatcaccgcgctgtttattccggcgggatggtttccgaatccgcagctgaatacattggtaagcccgatgattacgtatcttctgccgcttttaatcgcatatacgggcggaaaaatgatctatgatcaccgcgggggagtcgtcggagcgacggccgccatcggagtcattgtcggagcggacattccgatgttcttaggggcaatgattatgggacctttgggcggttatctcattaaacaattagaccgtctgtttaaagataaagtcagacagggttttgaaatgctgatcaacaacttcacggcgggaattatcggcgcggtgctgacgattatcgcgttttatgcgatcggcccggtcgtcctgtctcttaacaagttgctggcggcgggtgtggaagtcattgttcacgcgaatttgctgccgattgcaagcgttttcgtggagccggcgaaagtcctgttcctgaataacgcgatcaaccacggcattttaagtccgatcggaatcgagcaggccgccaaagcgggaaaatccattctgttcttagtggaagcgaaccccggaccgggactcggtattttactggcctatatgttctttgggaaaggctcttcaagatcgacagctccgggagcggcgatcattcatttcttcggggggattcatgaaatctatttcccttacattttaatgaaaccgatgctgatcctcgcggcgatcgccgggggagcgagcggactgctcacattctcgatctttaacgcgggtcttgtcgccgcatcatctccgggaagcatcatcgccattttggcgctgacgccgaaaggaagctatctcggcgtgctggcgggcgtcatcgtggctgcggccgtatcgtttatcgtctcggcgcttattctgaaatcgtctaaagcgggcgaagaagatttgacagccgcggcggaaaaaatgcaggaaatgaaaggcaggaaaagtgaagcggcggccgcattggcagacaaagaggaagagccggaaaacagcgccgctgatatttccgctgaccaagtcagccgcattatcttcgcatgtgacgcgggtatgggatcgagcgcaatgggcgcctccattttaagaaacaaagtgaaaaaagcagacctggatattgatgtgacaaatacgtcgatcaataatcttccgaatgacgcggatatcgtcattacgcataaggacctgactgaccgcgcgaaagcgaagctgccgcaggcggtgcacatttcggttgataatttcttaaacagcccgaaatacgatgaactgattgaaaagcttaaaaactaatcaaacagaaagagggatcttcatcatggaagtattggctaaagcgaacatcaaactgaaccagacagtgaactcaaaagaggatgccatccgcctggcgggacagacgttgattgataacggttacgtgaagaacggctatgtggaaaaaatgttcgaacgtgaagaaacatcatccacgtttatgggaaatttcattgcgatcccgcacggaacggaagatgcgaaggatgaggtgcttcattcaggcatttccgtcatccagattccgaacggtgtggaatacggtgaaggcaatacggcaaaggtcgttttcggtatcgccggaaaaaacaatgaacacttagacatcctgtcaaacatcgccatcatctgctcagaggaagaaaacatcgaacggctgatcagtgcaaagacggaagaagaactggccgctattttcagcgaggtgaactgacatgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacgcctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacgtgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcgcggaaaaaggcacgagcggcgttcttcaagacatttgcggtattcagccgcatgaaccgctgcacggcatcgtgctcaaaaagctcaatcaataaaaatgaacccgcgtcggggggacgcgggttttttcttgcgttataatgagagggaagggaggctgcgtgatgaatcagaagctattgccccatcgttttccgtttcttttgattgacggcacgacgaatagtgaagccggaaaatgggcggctgcttacaaaaacatcagtgaaaatgactggtttataactgaatcccaaagagagatgccattttcgctcgtcgttgaagcaatggcccaaacggcggcttgcgcgggaattaccggcggtgacggtctcggtctcttatccgcggtgaagaaagcggaaaggttaggtgccgctttgccgggagaccgtctggatcttttttttgaggtcacgcgaatcagacgcggttttgtgtttggccgggcgaaagcatccgttgccgggaagcctgtggcggaagcggagctcagcatatttatccagccatcgtaaaaaaagccgcctccaccggcggctttcggacaagcgtgttattttgtatcataatctctctcactttgtgaattgtccctctggtcatgtttgtgtttttcgtcattggcgttttccttcagctcttccagcggaatcggatccgttaaatcatgatgttcaggattttcattcggtttgttcttttgttttctttctttcatcctccatcacctcaatatttcttttcctcaacgctcgccccgccaaacgcaggaagcggttttttgttcctgtgggtcatatgtattaaaatagagacgactacaatataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcacaggacgcacgctgatgacctgccgcgaactggctgagtctctcgagctgtcatcctttttaatcacggcaaacggcagcgaaatctgggattccaactttgagctggttgagcgcaagcttcttcataccgatcatattcaaaaattatgggatctgaggaataagcacaacacgaatttctgggcctctaccgtcgatagagtgtggagaggggaattcccggaaacgattacggatcatcagtggctcaagttcgggttcgaaatcgaggatgatgaagtgcggaatgaggtgctgaaagagctcaaggaatacaaggagctcgaaatcacaaactcaagtccgatcaacatcgaagtcaatgccctcggtatcaacaaagcggctgcgctggcgaaggtatcggaaaaactcggcttcacgatggaaaatgtgatggccatgggtgacagtctgaatgacattgccatgatcgaaaaagcgggtgtcggcgtcgccatggggaacgcgcaggacatcgtgaaagaaacagctgactgggtgactgatgtcaacacggaaaacggggtcgccaaagcgatccgccactgggtgttataatagaaaaaagagagagtctcagcatgaggctctctttttttgttttgtcagatttgtgactaggtccatggtaggttttctgacaaaaggatgttcaaacttgtcagaattaaatataatgaagagaaatccaacaattcggaatagtcgttccaaatatcggaatgataataaaataaaacgtttacaatacaggagggagcttatgtttcagattgacatcaattgtgatttaggagagagtttcggtgcttataaaatcggactggatgaagagattttggattatgtgacatctgcaaacatcgcctgcggctttcatgcgggtgatcccagcgtgatgcgcaaaacggttgcgcttgcggcggaaaaaggcgtgaaaatcggcgctcatcccgggctgttcgatctgcagggattcgggcggcggcagatcgcgattacgcccgaggaagcgtatgatctgacgctgtatcaaatcggcgcgctgtcagggtttttaaaagcggaaggtgtcgagatgcagcatgtgaagccgcacggcgctttatataatatggccgccgtcaatcccggcctgtcagaagccatcgctcaggcggtctgtcattttgatcccgggcttattcttttcgggctttccggaagcgagctgattaaagcgggagatcgaatcggactgaggacggcaagcgaagtgtttgcggaccgcacctatcaggaagacggcacgctgacgccgcgttcagagccggatgcgctgattcaggatgacaaaaaagcggtcggtcaagtgattcaaatggtgaaagacagcacggtgacatcacgtaagggacaagctgtaaacctgaaagcggacacggtctgcattcacggagacggcgcccacgcgctgacattcgcaaaaacaatcaaaaaagaattaaaagcggcagacattcaaatcagcgcgcttgcaaaagactgagcagcagagggaggaagacagcatggagcaaaagaaaaaaacagccggaaaggcttccggcaaatggtcgcttcttttaggcgcgacatttttgatggcgacatcatcaatcgggcccggctttctgacgcaaacggccacgtttaccaatacattggcggcaagcttcggctttatcattttaatttctattattttggacatcttcgcgcaaaccaatgtatggcggattatcgcggtttccggaaagcgcggccaagagattgccaatatggtgcttccgggcgccggttatgccattgcttttctggtcgtgctcggcggacttgcgtttaatatcggaaacatcggcggcgcgggtctcggtcttcaagtattattcggaatcaaaccggagatcggcgctttaatcagcgcagcggtcgcggtgctgatttttgtcataaaggaagccggaaaagtcatggaccgttttatgcagatcgccggaatcgtcatgatcgtattgacggtgtatgttgccgtaacgacggctccgccggtcggacacgccgttgtaaaaacttttatgcctgatcatatcagtgtgctggcaatcgtgacgcttgtcggcggcacggtcggcggatacattacatttgccggaggccatcgcttgcttgattcaggcatccaagggaaggaagtcattcctcaggtgacgaaaagctccgtcacaggcgtcttgattacatctgttatgcggattgccctgtttctcgccgtgctcggcgtcgtttcaaagggtctgcgcattgatcctgataatcccgcggcttctgtattccggcttgcggcgggaaatgtcggctataaaattttcggcgtcatcatgtggtctgccgctatcacgtctgtcatcggcgccgcctatacatcggtgtcattcttcaaatcgttttcggcaaaaatcgaaaagcactcacatggcgtaattatcggttttatcatcgtatccactcttatttttgtcacgatcggccagcctgccaaaattctggtcgcggtcggttcgcttaacggcttaattctgccgcttgcattagcgatgattctgttgggcgcctataagaaaaaaatcgtcggcgattacaagcatccgatctggctcacgattgcaggggcgatcgtagtggttgtcatggcggttatgggcatctatacattattctcgcaaatgccgcagctatggagctgatgatatgaaaaaccatatgagtgataggggtcccgaagaagtcaggcagcttatcaggaaagggcagatgaccgggccgacggcgggattggccgcttcttacgcacaagccaatctcgtcgttttgcaaaaggatcttgcctttgattttctcttattctgccagcgcaatcaaaagccttgtccggtgcttgatgtgacggatgcgggttcacccgttccggcaatagcggcgccgggagctgatatccggacggactttccgaaatacaggatttatcggcatggcgtgcttactgaagaggtaacggatattacgccgtattggaaggataattatgtcgggtttttgatcggctgcagtttttcattcgagcaggcccttattaatcagcacatcccgatcaggcacatcgatgaaggcgtgaacgttcccatgtataaaacaaatattgactgtgttccggcgggcccgttttcaggaaagatggtcgtcagcatgagaccgattccggaaaggctggcagtccgcgcggcgcaggtcacgtcacgttttcccgccgtgcacggcgcccccgtccgcatcggaaatccgcaaagcatcggcatcagcgatttgcatcagccggatttcggagatgccgtaacggtgcgggaaggtgaggttcccgtattctgggcttgcggcgttacaccccaggcggtgatcatggaagcaaagcctgatatcgtaataacacattcaccggggcacatgctgatcaccgatatacaaaatgaatcgcttgctgtcctgtaagtgagaaagaatacaacgaggtgatgacaatgatgcagtatagcggaaatacagcgcttgatatacagccgtacggtgattccgccgttatcatccgctttggcgggcacatcagcgaagaggtcaacagccgggtgcaggcggcggcagcctgtatggaagaacggccgtttccgggcttcgttgaatgtattccggcattcacaagcttaacggtcttttatgacgtgtctgccgtctcaaacataaaaaaaggcgtctctccttttgccctggtcaagaaagaagtgacagaacgtctcagccatataatgaccggccgcaaaaaagagcgccgggtgatggaaatccccgtttgctacggcggagatttcggtcccgatttagaagaggtcgctgaaatgaacgatctgaccccggaagacgtcatccgcattcatactgaaggcgaatatctcgtttatatgctcggatttgcgccgggatttccgtttttaggaggaatgtctgagcggatcagagcgccgagaaaggcgtcgccaaggccgtccatcccggctggttcagtaggaatcgcgggaatgcagaccggtgtgtatccgatatccactcccggcggctggcagctgatcggcagcaccccgctccggcttttcagaccggaagaacatccgccgagtctattgagagcgggcgatacggtgaaattcgtccggatcacagcagaggagtacagccgcatcaaggagggagccgaatgagtatgaaagtggtaaaacccggtctcttgacgacggttcaggacacggggcggacgggatatcagaaatacggtgtgctgggaagcggcgcaatggatacgatctctctgcgcatcgccaatcttcttgccggaaatcaagaaaaagaggcggggcttgaagttacgcttatggggccagggccttcctttgagttctcagaacccgcggttattgccgttacgggggcggatttcgcctttcatattaatggggagcccgcccctctgtggaaaccggttttgataaaggaaaacagcgtcgtttcattcgggccgtgcaagatggggagccgagcttatctcgccgtcgcggggggatttgacgtgcccgccgtcatggaaagcaaaagcacgtatgtcagagcggggatcggcggcttttgcggaagagcgctgcaaaaagatgatgagctgccgctcggccgtatgacgccatgttcggaatcaatcgcgtaccgtctgagcgattctttcggacagcatggtttctcagcgcctgattggtctgtcagcagcagagggtttctgccgctgaaaaaaaatccggtcatacgagtgcttgaaggcgctcaatttcatgcttttacagaagaagcaaaattacgtttttatcaagagtcatatacggtcacgcctcaatccgaccgaatgggctaccggctgaagggcgctccgcttgaattgcgggagccgctggaaatggtatctgaggctgtgacgttcggaacggtgcaggtgccgccggacggcaatccgattattctgctggctgacagacagacgacggggggctatccgcgaatggcgcatatcatatccgccgatcttcctctcgtcgcccaaacgatgccgggggaacatattacgttccgggccgtttcgctggaggaagcggaaatgctgcttttggagaaggaacagcagctgaaggagctgaaagcaaggctcaaaatggaatggctgatctgacaaaggggctaaagaccatggaaaacaaaaacaaaaccgtcatcaaatcaatggaactgcttcatttgtttctcactgaaccgagcctgagcttaaatgaactggtttctctaacggaaatgccgaagacttcggttcaccggatggcaagctcactggaggaaacggggtttctcacccgggcggcggacggccgttatcagcttggtctgacctttttacaattcggccagctcgtctctgaacgtctggatatcaggaaaatagccaaaccgattatggaagagctgtgcagcgaagtggatgaggccgttcagctgatcatgagggacggggatgaagccatttacgtcgaaaaaattgaaggcacccaaaccgtccgcctgtatacggcaatcggccgccggtcgccgctgtacgcgggagcgtgcgccagaagcattttatcgtttctgccggaagaggagattgacacatacattcagaagacaaagcttgccgcaatcgcctcaggcacgatgacggatcgggctgaactgcttcactccattgaaagatccttgcaatcaggttatacgatcagctattcggaattagaagattatacggcggcgatcggggcgccgattttcaatcacgaaggtaaggtggctgccggaatcagcatcgccggcttcgaagcccggttttcagaggacaggctgccgtatttaaccgaaaaggtcaaaaacgccgcacagcatatttctgagaaattaggttattgaccgagccaatttttcttcactcgcgtacattacaatatcgatagtaacgagtggaggaaagtaaatgggacttgtttatacggcgctgggggattctttgacgacggggaggggatccgggccgttttccgccggttttgtccagcggttcgggcgcatgatggcagaagatttacagacaagaaccgacgtatccatctttgccaaatcaggccttgagacgggagaaattctcgggcttatgtccttcccgtacattcagaggcggattcaggctgctgatatgattacgattacaggctgcggcaacgatttgatcgattcggttcaggcatatcagcaaacatcggacgcttcggtattcaccagcgtgtccagtcactgccatgagaactttgaaaagatgatagccaagattgctgccttaaaagggccgcacccgtctccttatgagatccgcgtcttcaatttatacaatcctttcccgggcatctccattgcagaaaaatggatatcctcttataatgcgcacctcagcacactcgcatcggcgccgcacgtcaaaattgccgacgtccacagcgctttcaaaggaaaaatgaatgaatatctttcttatgaccgcgtacaccccaacagcaaggggtatgaagtcatggcatgcgtcctgcgggggctcggatacggaagcctcgccagctcataaaccgcgcgctccttttcatggggagcgcgcttttcgtgctccttaaaacaaacttaaaattgtccgactttcgttctatccgcgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctccgtcatacagccggttatgctcgtatttctcggtgcggtcatgttcattcaggggctggaggaaaaacggaaagaaaacgacggctccgggaaattcaatatctataccgccgtttttgtatggtcgatctccttaatcggttttacgcttcacgcgatctgagtctgatagatcctgaaaatgctccacaacgggaaatggtgaataaaaacggtgcagtaaggctttccactcctgatattccggcgatccgcgaaagccttttgtatgatcttctaatgtctcccattccacaagcagcaaatatttatgcgtcttttccatacatttggacaaggaatgggacagataacctttcatgcccgcgataatcggctccgcccggcggaatgcctcttcgaattccccctcaaggccttcttttacatacagcatggctgcttctctgatcatctgagattcctcctttttttaatagatacattgtataagaatatgggccgtgacggccggaaaaacaaaaaaattttaaacgctatgagaaaaaaatccttgccagcctgatttggtttaggagaaaataacagttggaaggcaggggaattgacagtgaaaaaagggttatacctattacttttactcgcaggaatcataggtttgatcggctgctcgaaaacggaatcggccgaagacagaatgaaagatttcgtaaaagactggaacggcggtcattacgataagatgtaccaaagcctcacccaggatgaaaagaaaaaacgatccaaaaaggattttgtaaaacgatatgaaaccatttatgaacaagcaggggtcaaaaatctgaaagtcactgccgaaaaacaggacgaagacgataagaaaaaagatgacctccagcacatcgattataaagtcagcatggatacaaaagcagggaaggtcgcttttgaaaacacggccgtcctgaaaaaagagaaaacagacgatggagaatcatggaacattgactggaatccttcttttattttcaaacagctttccgatgacaaaaccgtgcagatcgcaaatgaggaaccgaagcgcggacaaatttacgacaaagacggaaaaggtctcgccgtgaataccgaggtgccggaaatcggcattatccctggaaaactcggcaaggataaagacagcgtgatcaaaaaactgtctgaaaaactggacctttctgaagacgatatcaaaagcaaactgaaccagggctgggtaaaagacgactcctatgtcccgattcaaaaaatcagaccggatgatgaaagcaaggtcaaaagcctgcttgcattagacggcgtgacgaaaacgaaagtcagctcccgctactatccgtacggcgaaaaagcggcccatctgaccggctatattaaaaccatcacagcggagcagctgaaaaaagcgaaagacggccaatacagcgatacttccaaaatcggcatcgccggccttgagaatgtatatgaagacaagctgcgcggcaagaccggctggaaaatttacgtcccgcaaacaggtgaggtcattgctgaaaagaaagccgaaagcgggcaggatattcatgtaacgattgacatgaaaacgcagacgaagctgtatgattctatgaaagatgacagcggagcggcagtcgccctcgaaccgcaaacgggagagacactcgcgctcgtcagcgcaccgtcttatgacccgaacggctttcttttcggctggagcggaaaagagtggaaaaagctgaatgaagataaaaacaatccgttttcagcgaaattcaacaaactttatgcgccgggatcaacgattaaaccgattgccgcggcagtcggcctgacaaacggcacattgaaagcatcggaaaagaaaaaaatcaccggaaaagagtggcagaaagattcgagctggggcggttaccatgtcacacgcgtatcagagcgcctgaatgaagtggatctcgaaaacgcgctgatcacatcggacaacatctactttgcgcaaaatgccatagatgccggagcggacgcgtttacaaaaggattaaaaacatttggctttgatgaagagattccgtaccaatttccgattgaaaagtcctcaatcgctaacggcaagctagattccgagatccttctcggagatacgggctacggccaggggcagatgctgatgtctccgctgcacttagcggctgactataccgcatttgtaacagacggaaatctcgtcaaaccgacattgatcaaagacggagaaaaaacaccgcaaatctggcataagcaagtggtgtcgaaagccaatgccgaagaaatcacgaaagggctgagaggcgtcgttgaagatccgcgcggctctgcatatcagccggccgtaagcggcattaccgtagccggaaaaaccggtacagccgagctgaaaacgtctaaagaagataaagacggcaaagaaaacggctggtttgtcggttacgattataaaaagaaagacctcttgattgcgatgatgattcaagacgtcaaaaaacgcggcggaagccattacgtcgttgaaaaagcgaaaaagcagtttcagaatcattaaatgacgatttttgcgggctgaaaggaaaatcggccgccgaagcagaatgaaacagcatgggcaattcctgaaaacagagatacaagaggctctaagaaaaagggggatttcacatgcagcgcattcaattggctgaagacctggaattttcaagagtgatacacgggctttggcgtctgaacgaatggaatgtttcagacggagagctgctgaatctgattgaatggtgtatcagccaaggcatcaccaccttcgatcatgccgatatatacggcggttatacgtgtgaaaagctgttcggcggcgctttgtccctttcgccttcaataagggagcgaatcgaaatcgtcacaaaatgcgggattgtcattgaatcaccggagcggccaggaaacaagtcgcatcattataatacgtcgaagtctcacatcttagcgtcggcggagcagtcgcttttgaatctgaatacggattatctggatgtgctgctcattcacagaccggacccgcttatggatccggaggctgtggctgaagcgtttcacgcgctgaaaagctcgggcaaggtcagatatttcggggtatcgaactttaaagcgcaccagtacagaatgctcgaatcctatttggatgatccgctcatcacaaaccaaattgaaatctcggcgtacaagctggaaaatattcatgacggcacgctggatttctgtctggaaaaacgcattccgccgatggcgtggtcaccgcttgcgggcgggagcgtctttacaggacaatcagataaggccctccgaatccgtgccgcgcttcgttccgtacaggaagaaatcggcgccgcttccattgacgaagtcatgtacgcatggctgttcacccacccggcagacatcatgccgattgtcggcagcggaaaagagaaccgcatttccgccgcggtgcgtgcatccgcgtacaaactcagccatgatcagtggttcaggatttataccggtgtccaaggctgcgatattccataaacagaacaaacgcccggaaggtatcttccgggcgtttgtttatgtggtgtgcaatgtctaaaaacaagtaaggtcactttgaagtatagctgtgcggatcaagagtaacaagcgtcatggcatattatctgacacatttttctttttcaatactgtcacacggcccagtgccaaattgccatttgaaaatggttgaataatcattgaaagcgttttatattataatttacatcactttccccggcagcactccccatatgccatacttctcacaactagaaaatctggaggcgcgtttcatgtatatgacagcgagagaacaaaaattaatgaaacatctattactgcagaaccgttacgagacagtgcatgaactggcagaagctttacaagtcagcacaagaaccgttcaccgcgagttaaaaacaatcaaaccgatgatggaatcattcggtctggcacttgataaacagcccggcaaaggactgaaagcggtaggaaacccggaggacaaacaaaaactcctgtcagacctgtcctatgaacagcatgaatacagcgctgaggagcggaaacttttaattctatgttcactattagagtcgcaagagccgatcaagctctacagtctggcgaacgaactgcaagtgacaaacgcgacaatcagttatgatctggatgagctggagacctggatcgcgcccttcggcttgacgctgatccgaaaaaggggcttcggcatacagctgacgggtccggaaaatgcgaaacggaaaatcgtcggcaatctcatcgtcaaccggcttgatattcagagctttttggaagcggttgaatttaatattaaaggaaaacctgacgatgctgaaaaaatgttcggggtcgtaaataaagcggaacttttgaaaatggaccggctcttgattcagctcaaggaaaaaatcgcgatcgccttatctgacagctcatatatggcgcttgcggttcatttaacctttgcgatggaccggatcagactcggagaaaccatcacgatggaggcttcggaactaaaagcgctgcagcagacgaaggagtacggctctgcgctggaaatggcaaaagagcttgaaaaagcgttcggcgtttcaattccggaagctgagatcggttatatcaccattcatttgcggagcgccaaccgccaatacaaaacggaattcaaaccggaaaacattgaagttgaaacggccttgcaaacgaagcagctgatcggcttcatttctgaaaaaatcaaaattgatctgacggaaaacggttctttatacgacggtttaatcgcccatctggagcctgcgatcaaccgggtgaaagaaaatatcgacatgtacaacccgatgaccgagcaaattaaacgcgactactttctgctgtacatggccgtagaagaaggaatggaaaaattctttccggggcttcttttctctgatgatgagatcgctttcatcgttcttcacttcggctccgctctggaaatcaaacgggaagaagcgaagatcaaagcgctgatcgtctgttccagcggcatcgggtcgtccaaaatgctcgcatccagactgaaaaaggagcttccggaaatccgttcctttgatatgtcttccctcatcgaactgaaggaccgagacatcaccgcgtatgacatgatcgtatccaccgttccgatcccgtatggaaacattgattacgtcatggtcagtccgcttttaaacgaagaagacgctgatcaggtgaagcagtacatcaaaagaaaaattccgctgattcttgacaaaaaaagaaacggtaaaagagaagagaagcagccggagacgcctgatatgctggaagcggccggccgtatggcacattatgcggcggttatccaaagcgtgctgcggaacttttcgatcaaatccattgagtcaaacacggcgtacgaactgtttttgaatcgtttgtttgccatgcttgagcaagaaggatttgtccgtaatgccaaacaaaccgcacagcgccttgcagagcgtgaacgacagggcggactcggcattccgggaacggcgatggcgctgtaccatctcaaaaatgaagaaattgtcacgccttttttcaaaatttatgatttgacagctccatgcagtgtcaaaggcatggacggaaattccctgaccgtcggccgcgctttggtgatgatggcgccggctgatatgcccgctgaagggtcggaaatactaagtgcggtcagctccgccatcatcgagtccgaagacagtataaaagccttccagacggaggatgaagccgatttatacaaacgtttaaacaagctgttttatcatttcattcaggagaaaggacagcggtaaacagaaagcgcacacctcatatggggtgtgtttttttctgcatgtatgagggtaaggggaagggaagaaactaaaaacatgggactattgtatcattcatgaatggaatagttctaaaacaaaattgttttacaagttatattttttggtttaaaatgggttgcgtgaggaagaaaatctgacagagttttttgtgatttatgattatgggagatgaaaatatggagacattacagcatatgattctgcatgacatttcaaatagcgaagagatcgaagctgtaaaaagcggtgcgcataccctgacctacgcggaatatcgaaaacgaatcaaccagcttgcacaagcgcttcttgataaaggaataaaaaaaggcgacagagtggcgatgctttgcaaaaacggccacgcgtcatccattgtcatgtttgcggcactcgaaatcggcgcggttgttgtgccggtcagctggcaattaacaccttacgaaatgaaaggcattttagcagcctgtgaaccgaaagctgtctttttcggcactgaatttaaagagattatggaagaagttcttcctgcgctggtatcttctcttaaactgaaggtcgagacaggaacagctgcggagacaacgcctgagtttgacgctttattgacaggctccggtgatacaccggatgtcgaaacggtgtctgaaaacgatacggcattgctgatgtttacttcaggtacaaccggcaatccgaaacgctgcatgatcactcacggcggcatatacaactacgtaaacgcgacattggcttacacggggagaatgcagcatgtccgcttcttagcatgccatccgaattaccatacgagcgcgattatctgccagatggtcggcacgatgagcggaacgacattcattatgacagacaatcaggaccctgtggaaaacttgaagctcatcgaaaaagaaaaaattcaaaccatcatggcgctgccagtctatttcacatacctgctgaaagcatgggaaacgcaccagactgacatgtcttctatcgtttatatgatgacgggaggcacaaaggtgccaagcagcctgatccagcagtatctcgacatcggcatcccgctcatgcacggatacggaagcacggaagcgtggggcatcagctcttggaatccgcaaatgggaatggataaagccgcttccgcgggtaaaccgatggaagaagtggacgtccgcgttgtagatccggaaacaggtgaagtccttccgcaaggctcaatcggagaagtcgttgtgacaagtccgtttttattcaaaggctacgaaggtaacgaagaagcgacacgaaaagtgctgaaagacggctggttccataccggcgattccggctatgtggatgaagacggatttatctttatcaccggacgttataaagatgtcatcatctacggcggcgataatatttatcctgaccagattgaagaagtcattcagcaagtgccgggaattctcgaaacagcggttgtcggtatccctgatccgctctacggcgaaaagccgaaagcgttcatcgtgacaaacggcagagaagacctgacagaagaagaagtgacccgattccttcaagaacgtcttgctgcctttaaaattccggacattgagttcgtcagcgaacttccgaaaaacaaccttggaaaagtgagaaaagacgtgctccgcaaacaagcggtacgttcataatagagaacaaaaacccggctgccagccgggtttttttcttgcgttccatgtgaaacatttttctccgaaaacgttttgaactgtctcaatcatgtttatccggaagacagcagaggtagacaagaaatatgacaacgaaccagaaggaggaacttgacatggaaaactatccgaaggaattcccggcggaatcacaaaaccgccagccgggcattgaaagcgaaatgaatccggcgcctgtttacgaatacaaagaatataaaggcgctgacaaattaaaagggaaaaccgcgctcatcacagggggcgacagcggtatcggacgcgccgttgcggttgcttacgcgaaggaaggcgcaaatgtcgcgatcgtctattttgatgaacacgatgatgcggaagatacaaaaaaacgagtggaagaagaaggagtaaaatgtctgttaatccccggcgatgtcggtgaggaagacttttgcaatgaagccgttgaaaaaacggttgaagaattcgggcgtcttgatattctcgtgaataacgccgcggaacagcatccgaaagaaagcattaaagacatcacaagcgagcagcttcacagaacctttaagacaaacttttactcacaattttatttgactaaaaaagcgattgattacatgaagccgggcagcgcgatcatcaatacgacatccattaatccttacacaggcaacccgcagctgattgactacacggctacgaaaggcgcgattaacggttttacgagatccatggcgcaagcgctcgtcaacgatggtatccgtgtcaacgccgtggcgccggggccgatctggacaccgcttattccggcgacattctcagaagaaacagtcgcttccttcggtcaggatacgccgatgggccgggcaggccagcctgttgagcatgtcggctgctatgtgctcttggcctcagacgaatcctcttatatgaccggacagacgctgcatgtcaacggcggcagatttgtgaccacataaggaggctgaccgatgacgatatcgaaacatgacgtgaatgcatactatcaaaaagcgggaatcgttctgactgatgatgaagtcgaagacattcaaatcatggattacggcttaggcaagcttgaggaaaccgggcttcagctgtttatttacgtgaataccgaccgctactgttcgaaagaattggtgctcttcccgcgccagacgtgtccggaacaccgccatccgccggtcggcggcaagaagggaaaacaagagacattccgctgccgctgggggaaggtgtatctctacgtggaaggcgaaaagacagagaacccaagcgtcctcccgccggaagaagacaaggaatactacaccgtctggcatgagattgtgcttgagccgggcggacaatacaccattccgccggatacgaagcattggtttcaagcgggagaagaaggggcggtcgttacggaaatgtcatcgacaagcacggatgatcacgatgttttcaccgacccgcgcatttaaggatgaggctgcacgcctcatcttttttgtatggaaaaaaataaatttacctgtataatggctaataaaggaaagaaggtgcggtcgtgttttcctgtcaaatccgggaacatctgacgatcagattgcttgccaaagaagatacggacgaattgtattctgttatgaagcgaaatcaaaaccatctcagcgaatggctcagctgggcggaagaactggctgacattgatacgtaccgcgatgtgatcatccccgaatggcgttataaatatgcggaagagaatgggtttgacgccggaatttttgtgaagggccggttttgcggcatgatcagcatccataatgtcgatacagtcaatcaaaaagcagagatcggctactggctggatcgagagcatgaaggattcggcattatcaccgcaagctgccgggcggtcatcacccatgcatttcaggacctcgggctgaaccgcatcatgatcagcgctgctgaaaaaaacacgaaaagcagggcggtggcggaacggctcggatttcagagagaaggactgacgagagaaggcattttcgtacagggcgcctatcatgacacagtgaactacagcatgctgaagcgggaatggagcgaagatcggcagaagagcacatttcttggtttaaatggttccccaatgtggaaaagtaacagcggagacgttaaaaaggagtgattcttcatgaatcaaaatgaaatcaaagaaaaagtgcttgaagtactggatcatcataaagtcggttcgcttgcgacggtagagcaaggcaaaccgcattcacgctacatgacatttttccatgacggcttaacgatttacacgccgacgagcaaagacactcataaagcggaagaaattgaaaacaatccgaatgttcatattctgttagggtatgactgtgaaggattcggtgacgcttatgtggaagtggccggaaccgccaaactgaacaactcagcagatttaaaagaaaagctgtgggatccgaaactggaacgctggtttgacggaaaagacgatccgaacctggtgattctcgaaattgaaccgaagcagatcaagctcatgaacgcgggtgaaaaaacgccggccgagctggaactttaataaatcatttgattattcaggggcaatctgttatacttaactgctaagtgacaacatgcaaataaaaaagaaagtaaacttcttttttctgttttgatatagaagcttcaggcttcaacggacagcttgaaaaaaagctgagcttattcttttccttctgatattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgttaatacgaatcacccgcaggctaaggcgggcaaccatatattatttatttgcgtaagaaaagaataagacaaaaccgcgccggacatccgggcggtttttttatgtaaacggccgaaaccttgccgcagtctgcagagtctaatcagtatgaaaagatttggaggaatcatacattgcacgttattacttcacaagtactgtttatcttctgttttctgctgctgatacattcgattgaaacgcttgcctatgcaacacggctttccggcgcgagagtcggatttatcgcgtccgcgctgtcattatttaatgtcatggttattgtgtcgcgcatgtcaaacatggttcagcagccgtttaccggacatctgattgatgccgccggatcaaacgctctgtctgttgtgggcgctcagtttcgatttttaatattcggctccacggtcggaacgatgctcggcatctgtcttttgccgacattcgtcgcgttattctccagggcgattatacacttggcggacggaggaggctccgtcatgcaggtatttaaaaaaggattttcactgaacgggctgaagcatgcgcgttcttatatcagactgccgtcagtctcctatttaaaggggcttcaattccgaatgatcccgaaacgcttgtttgtcattaatatggtcattacgtctatttacacgatcggtgttctgtccgctctgtacgccggccttctggcgcctgagcacagcacgacggccgttatggcatcaggcttaatcaacggcgttgcgactatgctgctggccgtgtttgttgacccgaaagtctccgtactggcagacgatgtggcgaagggcaagcgcagctacgtctccttaaaatggacctcattgacgatggtcacatcaagggtcgcgggcacgcttctcgcccagctcgtattcatccccggcgcttattatatcgcctgggtgacgaaatggatgtaacgcaataaaaaagctcctctgcagaagaggagcttttttattgataatttctcaggccgcgatcataaataaaattaccgaacggaataaaggccgcgataaaaccggcggctgaccatttcacatgccatttgacagtaaacgccgcatacgccagcaccgccagataaatgataaacaaaccgccgtgaatggaaccggcaatggtgacggcgagcggatgatgagcccaatacttcaggggcatcgcgataaacagcagcaccaaaagcgacattccttcaataaaccccatcgtgcgaagtctgccgatcggcgtgtgtaacatacagctccctcctgtcggacatcttttttcctctatactataagcaaagggcagtcctaatatgaccatttcgcgtcagttcctgaaaaaaccttcatgatttcagcctgttgttcttgtcatttttcggatttctcttgataatatagccaaaagggtaaggaaggactacagtcatgaaactagataatgtggatctgagcatcattaaagagctgcagcgggacagccgcctgtccatgcgggagctgggcagaaaaatcaaattgtcagccccgtccgtcacagagcgtgtcagacagcttgaatccttcggcgttattaagcgctatacattggatattgatcaaaaaaagatcgggctccccgtctcctgcattgtcgaagcgacggtgaaaaacggaaaatatgatcaattcaaaacctacattcaatccattcccaacattgaattttgttttcgggtcgccggggcggcgtgttatatgctgaagattaacgcggacagtctggaaacgatcgaacacttcatcaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaagcatgtcaaaaacagttgtattagctgaaaaaccttcagtcggccgggacttggcccgtgttctgaagtgtcataaaaaaggaaacggatatcttgaaggcgaccgctacatcgtcacatgggcgctcgggcatctggtaacgctcgctgaccccgaaggatacggcaaagaatttcaatcatggcggcttgaggatcttccgattattccggagcctttaaagctcgtcgtcattaaaaaaacaggaaaacagttcaatgcggtcaaagctcagcttgtccggaaagacgtcagccagatcgtaatcgctacagacgcaggacgggaaggggaacttgtggcccgctggattatcgaaaaggcaaacgtccgcaaaccgattaagcggctgtggatttcctctgtgacggataaggcgattaaagaaggatttcaaaagctccgcagcggcaaagagtacgaaaacctgtatcattccgctgttgccagagcggaagcggattggatcgtcggcatcaacgcgacccgcgccctgaccacgaaatttaacgcgcagctgtcatgcggacgcgtccagactccgacactggcgatgatcgccaaacgcgaagcggatattcaggcgttcaaacccgttccttattacggtctccgcgcggcggctgatcagatgacgctgacatggcaggataaaaaaacaaaacagacaagaacgttcgatcagacggtgaccggccgtttggcaaaagacctgcaaggaaagccggcagtcatttcagaattgaaaaaaacggcgaaaaaaagcttcgctcccggtctttacgacttgacggaattgcagcgggacgctcataagcgcttcggtttctccgcaaaagagacgctgtccgtgcttcaaaagctgtatgaacagcataagcttgtcacttacccgcggacggattccagattcctttccgcagacatcgtgccgactttaaaagaccgtttaaacggtatggaagttaagccgtacgcccagtacgtcaatcaaatactgaagcggggcgtcaaagcgcataaaggattcgtcaatgatgcgaaagtatcggatcaccatgccatcattccgacagaggagccgctgatcctttcaagcctcagcgacaaagaacgaaagctttacgatctgattgccaaacgttttctcgccgtgttaatgccggcgttcgaatacgaagaaacaaaggtcacagccgatatcggcggcgaaacatttaccgcaaaagggaaaacggttcaatcgcctggctggaaagccgtgtatgatatgtacgaggatgacgacgatcatgaggaagacaaagaccagacgctcccggatcttcagcaggggcagcgcctcactgtctcatcattgaaagaaacgagcggtcagacgaaaccgccggcgcgctttaatgaaggcacgctgttatccgcgatggagaacccaagcgcctttatgcagggagaagagaagaaccttgtgaaaacattgggtgaaaccggcggactcggaacagtcgccacccgcgctgatatcattgaaaaactgttcaacagtttcttgatcgagaaaaaagaaaaagatattttcattacgtcaaaagggaagcagctcttacagctcgtcccggaagatttaaaatcgccggccttaaccgctgagtgggagcaaaagctctccgccatcgcagcgggcaaactgaaatccgccgtgttcattaaagacatgaaaacatatgcgggcaaaacggtgaaggagatcaaaaacagcagccagactttcagacatgacaacatttcaggcaccgcctgccctgattgcggcaaaatgatgcttaaagtcaacggcaaacgcggcacgatgctcgtatgtcaggatcgtgagtgcggcagccggaaaacgctggcaagaaaaacaaacgcccgctgtccgaactgtcataagaaaatggagcttcgcggccagggcgaaggccaaaccttcgcatgtgtatgcggccaccgggagaaactgtccgtctttgaaaagcggaaggcgaaagataaatccggacgcgcatccaagcgggacattaactcttatatgaaaagccaaaacaaagaggagccgatgaacaacgcgctggcagaacagctgaaaaaactcggcctggataaatagatcagagaaaggcagcatttgtaaagaaatgctgccttttgttgtgttttttactgtaatgggaatacgatccatgtgaagagggaaaaggtgagaggcggcgcttccatttaaaattttccaatgtgaaaaaatgctagtattcttttatcgtttcctttatagtaaaaatactttgtgaaaaaataagatatgggtctaaaaaagggtttgtaaaataggaggatggactgtgaagcaattcgtttttcgtctgatgatccttttgatttcgatcgttctgacggcggggtgcgcggaggccggacctgaaaaacagacggcggccgaaccgtccggaccgcttcagcccgcagagcattttatttattataaattgatgaacgggcgggggatgatccggacgaacatatccggtgagccggaatatttatctgagtctctcggactatggatggcatttttgctgaacaggaaagatgaacggcagtttcaagcgcaatatcagcttctcaccgattcgtttctgacgaaaaacgggctcgtgtcgtggaagattgacgggaataaagcgagcggcaccaatgccttaattgacgatttcagaatcatgaactgtctgaatgaggccggaaccctgtggggaaacagtgaatacgggaaaacagcggtgcagatcgggaaggcgctggaaaaatacaatacaaatgacgggtattttacggattattatgatgccgcttcaaatgccgcatcaaagaccgtgaccttgtcctatgttgaccccggcgccttacagatgctcagagaaaaagggattatcgatgagaaaacggaaaaccggaaccttgatgttctcaatcttgctcccctgaaaaatggttttctgccgaaatcattcaataccgaaacaaaggaatacaaatatgacagcgaagtgaatgtcatcgaccagctgtacgccgccgtgaatctgaagcggggcgatggcaaggctgccgcgctgtcaaaatggatgatagaggaatttaagtcgcgcggacagctgtacggacgatacagcgcagacacgaaggagccggcggttcagtacgaatcaccgtccgtttacgccctggccgttctttttttagcagaacaaaaagctgatccggctgtcatcaagccgctttatgaaagaatgacttcatttgaaacactggacacgctgaaacccgattacggcggctatatgagcgggagcgatacacattctttcgataacctgctgccgcttctggctgaaaggaaattgtttaatgaaaatatcattcaatgaatcacaaaaactgtgcagctacacagcagttatgctggtgctgctgtctttttttatttactatgcgtctcagcaatccgcagggcttctgataacctgcatcacattgcttgttgcgggagccggtatatggttcggggcaatctactcgctcgtcatgaccttactcgtcttatttgttctcggcagcctgctcctgtggtttcagaccgggagctttatggcgtctgccgatgccgaaagtctgcaggtgctggtcatttgggggattgcgctgctgctcttttcttacatagcgggaaggattcacgagttggcgaaggggcttgaacgctcagtgaaacagctgcgtgaagagattacgagctttgtcgccgtcgacagggtgaccggctttgacaaccatctgcggatgaagctggagctttctgaggaaatcaagcgggcggaacgctacggcaattccttcgtctttttgctgctgcacatgcattatttcaaggaattcaaatccctgtacggagaaaaagagaccgatcggctgctggcgtttatcagccgccaaatccggtcaagcgttcgggaaacagacaaaaaattcaggccgtccgccgaacggttcggcatcgtgctgacccatacgcctgaagaaaacatgccggccgttctggcgaagctgaaaaaggaattggatacgtaccggctgcaaaacggtaaatacgtctccatcaccttccgtgtatgttacttggcgtaccgaaaggatttacaaacggccgagcaatttttaaatgaactggaaaacgagatgatgatgaatgaactctaaatggatacgtctcttactctcggcgcttttcatgatttcggcggtttatgttccccgtccggcggaagcaaaagacaaaaaggacggcattctcattatttatacaagcacggacggcaaagaaaccgctgaggtcaaaatgcttgatctgaccgcgggccatttctcatccgccgtcactgtgaaaagcgacggagacatcacagccgcggacttcaaaaagaatcggcgcgtcatctattacggcgtcacgaaaaaaaagctcagcacatcatttgtgtcactgatcagcagcatgccgcagcagcttatcagcatcggctataacgccggacagttccgccaatttgcggggttgtccctgacagaaaaagaaacggtataccgcatttacggcaaaaaagaaaaaacagacatgccgcttgaaaaagggatgtccgtgctcggcgtatcgggagtaaaaggaaagtccctttatacataccggtccggtgacggcagcacccgcccttttatgtggaaaacggcgcgctctgactattatttcggcgtgacgagcctgttaaatgattcgtttctgacggcgaaagcgctgcgcagcgcattcggagaatcagagggcggcaccctcctttatttgcggcttgaagacatcagtccgatgtcagatgaaacattgctttacgaagcgggcgcttacctgcataaaagacatattccgtttattctggcggtcattccggtctatctcaatccggaaaacggagaaaaagtatacctggcggacaagccaaaaatggtaagtgtcctgaaaaaacttcagcaaatgggcggaagcatcattattcacggctacacgcacgcataccgatacagcgaaacgggagaaggttttgaattttgggatgccaaagcggatcagccgattacgtcagaaaatgcggatgatactccggtcaagcttgaaaaggaacaggattttccgaatgaaaaagcgtaccgggcgtatgtgaagcctttccgtgaaaaagaaaacatctacacgagaacgaagctggagcaggcgattgacgatctgacagagctcggcctttacccgctgtcattcgaagcgccgcactacacgatgtctgaagaaggctacaaaatcgcatcttcttatttctccagcattttcggacaagtgcagctcagcggcgcgacgtggaaaacctcgggcgcccctccgttcgtctcaaagccggctatgctggacgggatgacgctgtaccctgaaacaatcggttatgccgataactcaaaggaaaatccgctcggagatatggagaatcatatttctcagatgattgatttcggcggcggaacggcgggcggtttctaccatccgtatctcggcatgaaataccttcccgagctcgtcaatcagatggagcggattcccggcggcgagtggctcgatctgaagaaaacgaagcaaacggtaacgtcggacagcgtcaggatcaaaacggacggagacggaaccattcatgtggaaaacaagattcatccggtaacggcctttttcaatcatcaccagcagacgcctcttgaaaaagcgctttggattctctccggcgtggtgttattgtttatcatcatgttcgcctgctacgtcctttatttgcgcgctacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattccgaaatggcgcgcaaagatgggggagctcccgaaggtcagcgtgctcatccccgcgcataacgaggaggtcgtcatcaggcagacgctgaaggcgatggtgaacctgtattatccgaaagacaggcttgagatcatcgtcgttaatgataattcctccgaccggacgggagatatcgtcaatgaattttcccgtcagtatgacttcattaaaatggtcatcacaaagcccccgaacgccggaaaaggaaaatcttcggcgctgaactcagggttcgcggaatcgaacggagacgtgatctgcgtgtatgatgcggacaatacgccggaaaaaatggcggtgtactacctggttctcggtctgatgaatgatgagaaagcgggagcggttgtcgggaaattccgtgttatcaatgcggcgaaaacgatcctgacgaagtttatcaatattgaaaccatctgttttcagtggatggcgcagggcggcagatggaaatggttcaaaatcgccaccatcccgggaacgaacttcgcgatcaggcggagcattatcgaacagctcggcggctgggatgataaggcgctggcggaggataccgagctgaccatccgcgtgtataatctcggctatcatatccgctttttcccggcggctgtgacatgggagcaggagcctgagacatggaaggtctggtggcgtcagcggacaagatgggcgcgcggcaaccagtacgtcgttcttaagtttttatcccaatttttcaagctgaaacgcaagcggatcatcttcgatctgttttatttcttttttacgtattttttgtttttcttcggtgtgatcatgtcaaacacgatttttatcatcaatcttttttacgacctgcacctggctgtcgggtttttggcgatgattttgtggatactggcctttttcctgtttatgactgaggtcatgattactttaagcattgaaaaaacagaaatgaacaaacaaaacttctttatcgtatttctgatgtactttacatactcccaggcttggatcgtgctcgtcatctggtcattattcacagagatcaagcaccgcttgttcaagcaggaagtcaagtggtacaaaacggagcgatacaatcaaaataaaagcgggtgacctttttgaaaaaagcgatcatattgataactggccttttgctattgatgtataacgggcaggcggccgcggcccgggaactgaaaacggatggttccgccctcggaacaagcgccggcgcaaaagagcagcaggcgctgactggcgatctgatgacactgtacggggcgaaagacagcgcagagctgacctatcagattcctgcgggagcttcgaatgccgatcagtcgcttctgattgattacgaggcgtcaaacttattaattgccccgtcttctttaaccatcgccattgatgatgaacccgtcaaatccataaagcttgacggcagttccaagcggaaaacggtgaagctcaatctcagcgaaagccaatccgcccaaggctatcacaatgtatcattacgattttacggcgtcttaaaagagggcgtctgcgtcaggcaggatacgtcaggcaactggataaaaatttatccggacagccgccttgtgctttcagaagcaagcaagtcaaagggagcggatctcggccatttcccgtatccgtttgcccaatcaggcaatacgggtgaagaaaccgatattatccttcctgacaaaccgacctcggcggaagctgaagccgcagtcaaaacagaaggatttctgaaaacggcagacagcaggctgaaggtatcctatgtaaaagaatccgatgccggcaaaatcagcaatccgtcaattgtcatcggcgctgatcagcattggaacgggaaaataaaagagcttttcgaacgggggaacttcaaagcggaagacaacaaacttcttctcgccgaacgggttctgacatcaggggacaaacggcagcccgtcctgtttgtcacggcgcactcagacaaaacgctggcagataaaatccgcgtcatcacagacagcgcttattcaagccagctgggcggagatactttgacaatcggccgccttcagcccgctgcggaaaagacaggcaataaactgacattagaggacttcggcgcgggaaatgtaacggtcggatcaaacaaaacggcgtcagagcacttcttttaccctgcggcggccgctgttgataaagacggtaaggtcaagctttcacttacattaaagacgtcggaatcgatccggacgaaggcggattcagctaatgacgccgagagagcggagctgaacgtcatgatcaacggacagccgaatgcggtgcgccttgatgatctcggcaatcaagataaagatggcttttaccacgtctcaatcccgattgatccgaagcttttgcgaagcagcaggtacattgatctgcaatttgtcacatcaggtttgaaacataacaacccgtgtatcgaccgtgacgaaaataaatgggtctatattgataaaagcagcatgctgacgtatccggtaagtgatgcggcgcagaaagcggatttcgggcaatggccgctcccgtttgcgggcggcgtgaaagagaaaacagtaatcgtcatcccggatgacgtaaacatacagacactgaaagaactttctctggtggcggattcattcggaaacggctttaccgtaaagacggcatcagacatgaaggaagcggatgccaaaggccggaatgttgtgtttatcggaggcctgccgcaaattccgcttttgaaatcaaacgcctctaagcttctcgtgccgtcagaccgcagcggcgcgtacgatgtttcttcgtttcagatgctgaatgagacaacgaaacaagtcgcttttacccaggaatcaccttgggactccggccgaagcatcgctgtttttgctccgttatcaggcagcggcgcgtctgtcacaaaagagctgatcagctttttagacagcacaagcgatgccgcaaccgtcgtcaacgaaacggccggcaagcagctgttttcaaaccatcagcaaatcaaatccgacgacagcagtccatcgcctgatacgaaaagccgttccgcagcactgaacgtcacgtatatcgctgttttcgctgcgcttataattattgcggccggtctgatctggctgacggcaagaaggaaaaaaagaaaagcggacaatgaaaaaagtgaagagtaatgaaggaaaaagaggccgttaacaggcctctttttttgtatttttatttccatttttggcggtgatttttttatttttgaaacagcataaaagcccctttacaactgaacgggacgggagtatgatctcttttataatctatatcgcttaatctgtaatcagagcgggggaaccaatttgcggcgcgtcatgccgcttggggtgaatcctttttcaggtagggccaactctcatcagcccgaatccgacagctaacctcgtaagcgttcatgagaggagatgaatgaaacctgtgcacgattatggcgcaggggcatccgtttgcctctgtgtctttttgctgtgccgaaatatggcatgcaatcgttattcagagacatcatagcagtaagggtttgtaaatcaaacggaaaatgaaaaaaaggggaagacaaaaaatgtaccattcaatcaaaagatttttgattgggaaaccgctgaaatcacaggcggccggagagcagaaactcacgaaactcaaggcgctcgccatgctttcttcagacgcgctgtcatcagttgcttacggaacggaacagattctgatcattttggctgcggtaagcgcggccgcgttttggtattccattccgatcgcagcgggtgttctcattttgctgcttgctttgattctgtcctacagacagattatttacgcttatccgcaaggcggaggcgcttatatggtttctaaagaaaatcttggtgagaagcccggcctgattgcgggcggctcattgcttgttgattatattctgacggtggcggtaagcatttctgccggaactgacgcgattacatcggcatttccggctttgcacccgtatcatttgctcattgctgttttgcttgtgattctgattatgattttaaatttgagagggctgtcagagtcggcgtccattttggcgtatcccgtctatctgtttgtggcggcgcttgtccttttgatcgtcgtcggactgtttaagctcatgacggggcaggttcatccggccgagcatacaccgatcggcacgcccgtagcgggcatcacgctgtttttgctgctgaaggccttttcatccggctgctcggcactgaccggtgtggaagccatttcaaacgcgatcccggcctttaaaaatcctccggcgaaaaacgcggcccgcactttggccatgatggggattctgctggcgatcttatttacggggattacggtgctggcgtacggctacggcacgggtccgaagcctaacgagaccgttatttcacaaatcgccgcggaaactttcggacgccatacggtgtattatttcattcaaggcgttacatcattgattcttgtgcttgcggcgaatacgggcttttccgcatttccgcagctggcgtttaatttagcgcgcgatcagtatatgccgagaatgtttacggtacgaggcgaccggttaggcttttcaaacggcatcatctttctcggtatcgcgtccatcctgctcattcttttattcggcggccgcacggaacatttaattccgctttatgccgtcggcgtgttcattccgtttacgctgtcgcagacgggaatgtgcatcaagtggatcaggcagaaaccgaagggctgggcggtaaaaatgctgatcaactcatgcggcgccgccatttcatttatggtgctgtgtattttattcgcgacgaagttcaatcttgtctggccggtgctgttattcatgcctgctgtcgtcatgctgtttttcgtcattaaaaatcactacaccgcggtcggcgaacagctgcgggtcgttgatcagcagcctgaggaaatcaagggaaccgtcgtcatcgtgcctgtcgccggtgtcaccaccgtcgtccaaaaatcgattcagtatgcgaaatcattatcggatcaggtcattgcggttcatgtttcctttgacagagaacacgaaaaaaaggtggaaaagcgctgggaagagcttcataacggcgtccgcctcgtcaccctgcattcctcataccgcagtctggttcacccgtttgataagtttttggaaacggtcgaacaaaaagcgaaaaaagaacagttctccgtgatggtgctgtttccgcaatttattacgaaaaaacgctggcagaccatccttcacaaccaatcagccttcttgctccgcgtccggctgttttggaagaaggacatcattgtcgccaccctgccgtatcattttaaaaagtaacggcaaagaccgcaggctgaaatgccgcggtcttttttgtaaaggaggacgacatggcacaaggcgcgtttgtcatcatacaaaatgaggggcgggagatattgctcgtaaatcgaaaagatattcccttatgggatttgcccgggggcagggtcgcagaaggtgaaatacctgaagccgcagccgtcagagaggccttcgaagaaaccggttataacgtgaccattctgcataaagcgggtgagtatgaaaggccggcatttgaagatacacagcatgtattcatcggagccattaccggaggaacaccgctgatgaacggatcggaaaccgccgatttacgctggttttcccaaaaccggctgccgctgttcatggtgccgaacagaaaacggcaaataaaagacggactcaatggggcggcaaatcgtaaggcagtccttaaagaccgaaatctgttatccatccttgatcggctgagaaaaaagctgagagtatagcccgtgtttcaacccgtatgaaaaaggggatgaatacaggtaaaaggaggatgcagtatgccaagtaaaacagcaggacacgtaatgacggagctgcttgaacaatggggagtcggtcatatatacggcattcccggagacagcattaatgaatttatcgaagaactgagacatgaacgaaataacctgacattcatccaaacccggcacgaagaagtcgcagccctggctgccgcggctgaggcaaaactgaccgggcagatcggtgtctgcctttcaatcgcaggaccgggggccgttcatctgctgaacggtttatacgacgccaaagcggacggcgttccggtgctggcgattgcgggacaggtggcttccgatgaaatcggccgtgacagctttcaggaaatcaaattagagcagatgtttgaggacgtggcggtattcaaccagcaggtacatacggcagaagcgctgcccgatcttctgaatcaggcgatccgcacggcttacagcaaaaaaggcgttgccgttttaaccgtttctgatgatttattcgcgcaaaaaatcaaacgggagccggtttacacatcgccgatatacctcaaagccgatatagagccgaaaaaagaacatctcgtgacatgcgcgcaatatattaacaacgcaaaaaaaccggtcattctcgccggccaagggttaaaatcagcaaaagaggagctgctcgcattcgccgataaagcggccgctccgattgtgatcacccttccggcaaaaggcgtcgtgcctgacagccatccccactttctcgggaatctcgggcaaatcggcacaaagcccgcctacgaagcaatggaggaatgcgatctgctgatcatgctcggcacatcgttcccgtacagggattatctcccggatgatacgcccgccattcagcttgattcggatccggcgaaaatcggcaagcgctatcccgtcaatgcgggaatcgtcagtgatgcggctctggggctgaaagagctgacggaatacattgaatataaagaagacagaagatttttggacgcctgcaccgagcacatgaagcattggtggaaggaaatcgaaaaggatgaaaccgaagcgactcatccgctcaagccgcagcaggtcattgcccggcttcaggatgcggccgcagaggacgccgtcctgtcagtggatgtcggaacggttacagtgtggatggcccgccattttaaaatgaagaagcaggactttatcgtctcaagctggctcgccacaatgggatgcgggcttccgggagcgattgccgcaagccttgccgaacctgatcggcagtccatcgccatttgcggagacggcggattttcaatggtgatgcaggatctgccgacggctgttaaatataaactgccgattacggttgtcatattaaacaacgaaaatttaggcatgattgaatatgaacagcgggtcaaaggcaacattgactacgtcacccagctgcaaaatatggattacgccgcctttgcagaaagctgcggggcaaaaggcatcaaagtgacgaaacacgaggaattggctcccgcttttcatgaagcgctcaactcaaatgagccggtcgtcatcgacgccgtcatcggcgacgagccgccgcttccgggaaaaatcacttacggccaagcgaagggcttcagcaaatacatgctgaaaaacttctttgaaaaccaaaaaatcgaaatgccgtcactcaagaaaagcttaaaacggctgttttaagaagccggtggttataaaaaaattaacaggcagcatgcctgttaatttttttaggctttcttattgatgattatttctttactgccccccttccatggtaaggaagtggtcagcagtttgacccgcttggaagcttagaggacgggaaccgtaaccgaaagtatatcgtattaaaatctccggaaacggtaaaggaggtcgtaaaattcgcagctggcgagcgatggctgatcaaaaaactcgtgatggatcagcgcggtttcatctgaagaacagccagagagcggtcacaacagcgatcataaagtaatctccatctttcagtttagttccatttttgacaaacacatgtgccgtccggttcgtctttgtccctttcggagttttaagcgcaatgttcttccctatattgtaataaacaattttaaacaaataatatgccagcgaacagaataaaaagagcaacatgaacttgccaataaacaatatcatgtttcattactcctttttgccgttttgccgtttgaatatatgacggaaaagtcaggatgttatataaaaggagaagtattttaccgaggctggtgttaaacattaatgaacggttcgccgcaacatccccagatccggaacaatttcaaaacgaaagagaagcccgaggattattaaaaacagaccctaatttgtccgcttttttttgaacatttgatccaagatgaacataaagagagtgaataagaaggacaccgtaatcatatctatcagagatagattagaggtttcttttattagtagcagccataccacctgcaaaactaaagaaatagaaaaataagatatatatgtcatgatcctcatatttgttacccccttagcctaatttctcttttgtgatcttatccaaattagtaaaaaggatatccaatcccgaaaataagaaagtgatgaacaatgaaagaagaatttctccaccttgaaatatagatatgttctcaatgatatgattggaaacgtattggattgagaagtaaacagcagcccatgcaaaaatgaattcaaggatataggctgaccaagcaggcaatgtcaaaacatgagtcattccttttacaattgctgtaaggataagcatataaactaaagctaaaatactgacgacgacagaaaatatgtataagtctgaaagtgaaccatagatgatatattctccgaaaaaatgatttacagttatagctgcaaaataaataactaggctgggtacagttatagcgaagaacagggagaatccaataagtatgatgaatgctgcatgagctaagcggtttggcggtgtatccacgatctctttttttaatagaaacataaaaataagagatgaaatcacaaggcagcataagaaagtgagcaaaacagtaaaaaagacagtcatgtgacatctccaatgaaaaagtgctattagagtgaatctaacagcactttgcatttacttcatacgtattttcctgacgatcatttatgaatgattttaaaaagctttcattgctaaagttgtcaaatgagcgaggtttttagcctggctgtcagaaagtccggactttttaagtgagagataaagattcttttccacatcagtccagcttaaggcgacatactcgttcagcattttctttaaaaccggttctatatgttgattgaaaacggattcgagttcatttcttattttctttcccgctaatttttcaacaagattgaataattttgttttatttttcagcacctctctgattgcatctttgactggttttgacacagatgcatcgctttgtgctttaagtccgtaggaaaattgcgtatcagtctgataaaaaaatgattttgtcgttccagtggcattggcagtattatgatgattttctttagctaaggatgcggggacaaaagcagtagttacaagggctaaagatgcggcaaacagaatgcctttagctgcgtgtctaatgggaaatcctcctttagaaatgtagtgtagagagaaatgaaagactatgtatttaggcgggacctgtatgatccgctttgaacatttttccctctcagataccattctatcaataggtattttttgggtaaataggattttaatacgatatttttctcgcaattcaaaatttttttggcaggatttattttagctgcagtttcgtgaaatgaacatgggctggagcctgcatgtataggctgattgaggcggaatcacattatcggagcggtttttataatgcaggccaggcttaggtaaaaaaaataaacaggcggcatgcctgtttattttcgtttgcgtgaaagagcgaagaaaaacgggaaggcggaaccggccaaaaacgtaccgaataaaaacatgcctccgatgaacacatggtagttcaccccgccgatccaaagccccgtgattaaggaaacgatacttaatgcgatcatcacaaagccgggaatcagacgtttcttacccgttgtccgataagcaaaaagagaacagaagatgccgatgacaatcggcacaatccacagataaaaaaggataaatactgacataagcaaaactccgatttttcttctatcataccaaaaacgcccggaaaaagatacgaacggcacccggcgtcaaaagaaaaaccggccgctgacggccggtttttttctaacggaatgaatcgtaaatcacaaacagattaagcgcgatcaccaaaaccgcaatcagccaggcgagagccgtcacccattttcggttcgtcagggcgcccatcaggcgtttgttgcttgtaaacataatcagcggcacgagcgcaaaggagatgccgaatgaaagaacgacctggctccatacgagcgcttctgtggcgttgacccccgagataatgatgatcatcggcggaatgatggtaatgaaacgccgcaaataaagcgggatacggtaacggatgaagccctgcatgataatatcgcctgacaatgtgccgacagaagagcttgaaagccctgcggccagcagcccgatcccgaagagaatggctgaagccggtccgatatagtggccgaattgctgataggccacgtctaaatcttctacatacagcccgttcttgaagaaaagcgcggcagcgacgatgagcatgcttgcgttaatcgccccggcgatcaccatcgcgatgagaatgtcaatcgtctcgaatctaaaaatctttttccgctcattatccgtttttccgacgacacggcgctgtgtcagtgcggaatgtaagtaaatggcatgcggcatcacggttgcgccgagtatcccggttgccaagagcacactgtccattccgtcaattttcgggataaacagcccttcgagaacagagccggcgtcaggtttggcaaagaaggtctgcagagcgaaggcgatcaccacgacaaacagaagtccggcgatgcccgcttccagcgcccggtaaccccggcgctgcagctctaaaatcgcgaatgatccgatcgccgcgataatggccgcttcaaccatcggtatgccgaacagcaggttgagcccgagcgccgccccgataaattctgccaggtcagttgccataatcaccagttcaccctgtatccacagcccggcggatacccatttcggataccggtctctggcgatttccggaaggtttttacccgtggcaatgccgagcttcgcggaaagaacttggattaaaaaagccatcaagtttgaaaagaggatgacccacagcagcatatacccaaatttcgaaccagctgagatattcgtagcgaagtttcccggatcaatgtaggcaatcgccgcgataaaggctgggcctaagaaaggcagaagccgcttgaatcccttgcttttgccgtcaagtgcatcctgcacggcttttgcttgcagtgattgtgctgagatgtctttgctcattatgtctcacctaaattccgatagatttttagctaaataacaaaaagtttcctagatgcaaattattttatctacatcataaatccgctattatgagatgtcaagttctttatgttcaataaaccggtacattgatgccctgttttatctatgatatgtatcccgccgaagaaaggtccgaaaatgaaaacggcatcgttccgggaaagaagcgatgccgttcgcaaagcatgtttccgcgtccgatcatgcgcggatgcgttgagcgttcttttaaaaaggtgaaaagagaacacttgctcatatcacttcacaactttctgtccggtgcaactgatcctgaggaaaagacgcagtatttcctccgttttcccgggtaaatagaataataatgtttctttccattggaagataaaacctttctgtaccattcaaatgacctccggaaaaactccggccgctctgaataaacgtttgaatcaacgatatatcagtgattccagtccaataaacggctgttatctatcaaaaaaagaatcggcatggtcacttgcgaagaaaagaagttggagcattagacttatttcagtctcccgggcaaaaaagtataataacgtcaggaaagctttccggccatatgataaaagagggggaattttcttggtacgtcgtttgtcgatcatttctttagccatgatttttgctgtttctttattcgcttttggcggctctgcatcagcagcagctttcaaacctaaagctgaaccggacgtttccattttagccagcgggggcacagtcggtatttacggtgctaatatgcgctcatgctctaaggtcagctgttcaacgatcacaacattctcaagcggtaaaaaaattacaggttcttgggtcaccggagaatatgttcaaggccactacaccaattccaataaatggctgaaagtcacgtatgcaggagcgacaggctacgtttcagtcaccacactatcttattattacggtttataagcagaaaaacctcgttctcttgagagcggggtttttctatattccgattcaatttccgcgtttcgtttcatcatcgtgtttcatcagctgatcgatttcttctttagaagcgttttttttccactctttcgcctgacttgtcgcaatgggaatagcccgtccttcttcataaccctcatctaccatcgcattcgcgatttcgatcgcttttttcttcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaagtacagattgaatgcccaccacatgagatcaaaatcaccgataaatacccaaaaggcaatcgcttgcaggcctgaacaaaaggtcagcacaagtgatattaatgcgaaagggcgccataacgcatgtttccgtttataaagaaacaagctgtacagcccggtcaatgaaatgaaaatatctaggggaaagaatgaccagttccaggccattatcatggcgttatcataatctttaaacgccatgttttttggaatccactcaaaaaaagtaacaatccaataaatgataaatccaatatctgtaatgaggaagagaacctttaaccctttcatcatctgtttctgtccgcatgaacgctgatgccgtttgatgacgtttcactttcagaaataaagtttaaggaaacgacaccgatgatgatcagaagaacagagacagcttttatgacagagaactgttcatgaaagaaaaaaattccgatcatggaaatcagcacgatccccattcccgaccagaccgcatacgcgatggagacacttatatatttcaaagtcaaagtaagaaaacaaaggctgccgatataaaacaataacaataaaatacttggaacaagttttgtaaatccatttgataatttcatgctgaccgtacccaatacttcaaaaatgatcgctaaacttaaataaatccattgcatacagcattctccttcaatcgtattattcaaaattatacaatatatagaatttgaagaaaattaatcaatggaatgttttccggataaaaagtccggccgggtgtaaaaagaaaacgccataaaggtatactatgtagaaagaaatcagaaaggacgtgcaggacgggtgacagaagagcggacagacctggaaagacaactgagagacattcaaaaatgggaaaaggcgcagcagagggcgatgttctggcaaacattcacccgcttgccgtttcagcttttggacaagctgacaccgcaatttattcagaggaaaatcggactcattctcgatgaaacgggaacgtttattcagtcaggcggacagtaccttacatcagaaaagcgcatcatgaaaaagtttcaaaaacggctgccgcacggtacatgtcaaacgcttcacgacatccgcaatgcgccgcttgccgtcatggacgaaatcgcagaagccatagcgcgtacaagcgtaaaggccgcgacggtgcagggagccgcaacgggagtcggcggcgtgtttacgcttgcggcagacattccggcgatgctcggcctgtccttaaagacgctgcaagatatcgcggttgcttacggctttgatccgaaagacaaaaaagaacgcgtgtttatcgtcaaattgcttcagcttgcatccagtgacgtcatcggaaaaaaagcgatcctgcaagatttacggcaatatgatcaaaacgaccaaacctatcagcgcgtcgcctcgcaaatccaaggctggcgggaagtcgtttacagctaccgcgatacgttcgccgcgaaaaaactgctgcaaatggttccggccgcaggcatcatcttcggcgcgtccgccaaccgttcagctttagaaagcatcgcggaaacaggcatcatgctttataaaaaacgccggattctaaaacgcatgaacgatacagaatgataaaaaaccacccgaaaacacattcaatgtgttttctttgtttatcagttctgaaatcgggaaaccaacaaccaacaccaattaaaggaggaattcaaaaatggcacaagataataacaaaatgagcagagaagaagcaggtaaaaaaggcggagaagctacaagcaataaccatgacaaagaattctatcaggaaattggtcaaaaaggcggagaagccacaagcaaaaatcacgacaaagaattctatcaggaaatcggtgaaaaaggcggagaagccacaagcaaaaatcacgacaaagaattctatcaggaaatcggtgaaaaaggcggagaagccacaagcaataaccatgacaaggaattctatcaggaaatcggccaaaaaggcggagaagctacaagtaaaaatcatgacaaagagttttataaagaaatcggccaaaaaggcggaaacagacgaagcagctaataaaagcataaaaggcagacaacctgcagatcaaaagcgatccggcacatcagccggatcgcttttgattttgggaaaatcttgatctgagccgcaaaaccgatacaataaaatgaaaaaggggtttttcactcgtgtctgacatgctgaatttgctcgctatcgccaataaagtcaaagaaaaacacgacaatttttcaatcgcggagatcaatgaccactgtgtgcgcctcgcagtgtttacgggagaatatgactggcaccatcaccctgactcagatgaatggttcatcgttctggaaggtgagctgctgatcgattttaaggacaaagaaaccgcagtgctcaaagcaaatgacagcctgctcatcccgaaaggcacgattcaccgcacccgctcttacgtcagaaccgtgaatctctgtgtcgagcatacgcatgcgaaaacagtcatcacagaggaacggtcatgctgatcaaaaagattgtatgtgaaacagacgctgcaaacgctgaagcatttgcgcaagcacagtcaaggtggggagcattatcatgtgtaaatggcttcgtcagacaggcaggcggctggcggaaaaacgcagacggcctgttcatcgcagagatcatcagcgtttgggaggacagacaggcctatgatgattttatggagaacgaacatgaccgcatatacgaagaaaacgagcagaaggctgcgattctttcaatagaagtgatgctgtacgagggggatgaacctgtcattcacgagctgttacatcaccccgacatccggtacgaaccggactggacagttgtgcgcacataaaaaaagcccctttagaggcttttttattttcgtccgggaagcgtgttgtggacatacggcgggacggggtccagcttagctatttcgccgtgcgctttcggttccttttcgtattcaaatggttctccgtccggcgctgtttccttcagccaattttgttcagcgctttctgctccatctgagaaatgaataagcttatgggagaatgactgtttttccagcgccttcgggaatgtggaaggaacgatcggaccttcctgttcttctaattctttaatggccgcaagccattggttttgatgcatggtatcgcgggccaataaaaagctgagcatatctttcacgcctttatcatcggtcatttcatacaggcgtgcgacttgaagccttccttgtgattcggcgttcagattggcgcggaagtctgccagaaggtttccgcttgcgacgatatagcctgcgctccacggaacgcccgtgctgctctccggcatggcgccgagtcctgagacaatggcatgatgcgggttcatcccgcctaaaatggacccgatgaccggatcatcagccgctttttcctgctctgccagcggggcgtcttctaacagtctcgcaatcatcgtcgcgatcatttcgacatggccgatttcttccgtcgcggtatccatcagaagatccttatatttttcattgccccgtgtattccatccttggaacaaatattgcatggcgacggatatttccccgtattgcccccctaaaatttcctgcatcttttttgcgaacagcgggtcaggacgatccggtttagccggatgctgcagttttttcgtatgtgtaaacatgtctccatctccttttttgctctgtccctatttacttccccggcgggaaaagggatgaaacggagatgggcgtattggtcctgctaaggctcgcggcgcaaggataacaaatcctgcacaagcccgcggccgatcacctgttcatattgtccgtaaatcgggtcgaggcgtttcatccatgtgttcttttcagctttgctcagcacatgaatatgaatggatgaattcttctttatctcttcaagctggtctttattcattttctcagcggaggcttcgttccattccgtcgtttctctcatcgcctccgttaagatggttctcgttttttctgtctgtgaattccagaaatgctcgtcggtcatcacggcataaccgaggtacccgtgattgctgattgtcaaataatcttgaacattataaaattttttagaatagatatttgaaatcgtattttcctctccgtctacgagattgctttccaagagctgaaacgtggaattaaaggaatcctgccgcgggtgcgcgccgagcaggcggtactggtcttcgatcacgctgctcggcatgatcctgagcgcctgtcctttcaaatcgtccggagagaagatcggccctttatttgacgtgagctgcttaaacccgttcgtccagtacgccagtcctttcaaatgatgcttttctaaagaagcgaacaggcgcgtgccgattttgccgttgaggccttcttgcacggctttatagtttgtaaacgcgtacggcagatccaaaacaccccattcgggagacagtgatccgagctttgaggtggagggggcgatgaattgcacgtccccgttttggagggcgtttatttcttcattatctgaatagaggctcccgtttggaaatacctctactttaatggtgccgccggacttttgatagaccaggtcggcaaatttattcgccgcccgccctttaggcgtgttttcagccacgacatggctgaatttgaaaaccatttgatctttcaggccttcctgttcgtcatcataatacggttcttccgttgagaaacgatcatgaaagccgatgaataaagcggttccgataccgagtaccatcaggctgagacaagtcagcaagcttttcatcgaaaaccccctccgccattttctataacaagcataatcgggcgggccgttttcgtaaagagacggaaaggaagaggccaatgacgaaaaaaaagcttaccatccgctggaaaatcaccatactttcttatatcgtcgtgctttttacctttttgatcgtcggcatcgtgctggtcggcaatatccagcatacagaggagcgcgagctgaaaaaacggctgatgaataccgcgcggacggtatctgagatgaccgatgtcaaacgcgccctggagcagaaaaaacaaagggaagatgtgcgccatgcggtcgaagaaataaggatcatcaatgaagcggactacatcgtcgtcatggatatggatcatatccgctattcacatcccgtcagcacaatgatcggaaagcgttcaaggggtgaggacgaagccgcggcgttcgccgagcacatttatttttccgaagcaaagggagagatcggcaccgccgtccgcgctttttatcccatcaaagaccgggatttgaatcagatcggcgtcgtccttgccggtaaaacgctgcccggattcggtgaaattcttcttcagctgaaacatgaaatactgtttatcgttctgctggcgctcgggttcggactggccggctcctttttgctggcccgccacatcaaaaaacaaatgttttggctcgagccccatgagatcgtgagaatgtatgaggaacggaccgctacgtttcattcgatgaatgagggcgtcattgcgatcgataatcagcatcacatcaccatttttaatgaaaaagcgaagcagatattcaatgtcagacaagagaccgacggcaggctgatctgggacgtgttaaaagattcgcggctccctgaaatcgtcgagcggaaccgagccgtatataatgaagaaatccaagtcagcggaaaggtgatcatgagcagcagaattccgattgtcatgaaaaagaaggtcatcggagccgtcgccatttttcaggacaggacggaagcggcgaaaatggcggaagaactgacaggtgtgaaaaattttgtcgatgcgctcagagtccaaaatcatgaacatatgaacaagcttcacaccatcgcggggctgattcagctcggaaaatcagaaaaagcgctccggcttgcttttaaggaatcatcagaacaagaaagcgtcactgattttcttcatcaggccattcagaatgacgccgcggcggggctgctgttaagcaaaatcaaaagaggaaaagagcttggcatttctgtgaaaattgatgaaaacagcagtttctcggcatttccggagcatgtcgaccagcatgacatcgtcgtcctgctcggcaatttaattgaaaatgcgttcggcgcattcgaaacagcggacacggaggacaaacatattgacatcagtatcgagcaaaatgatgaagtgcttgctatattaatagaagacaacggaagcgggatttccgatcagcacatcccgcgcctttatgacaaagggtttaccgtcaataaaacgggaggaacgggatacggcttgtacctcgtcaaacaaatcgtcgacaaagggatgggcgtgattgaagtcgacacacggcagggacagggaacggcattttctatattatttccgatgaagggggagaaatcattcgatggacatcaaggtgctgcttattgaagatgacccgatggtgcaggaggtgaataaagaatttatcaccggtgtttcagggttcagcgtcatcgccacggccgctgacggagacgagggaatcaggcttataaaagatctgcggcccgggctcgtggtattagacgtatacatgccgaaaaaagacggaattaaaacgctccaggaaatcagaaaacaaaagctcgaagtggacgtcatcatcgtctcggccgcaaaagacaaagaaacaatccagcttatgctgcaaaacggtgcggccgactatattttgaagccgtttaagctggagcggatgagacaggcgctcgaaaactataaacaatataaacggaaaattgaagagcatgacacgatgtcgcaagagcagcttgacatgctgctgaaaattccgcaaaatccgtcccgggatttgccgaagggattaaatcattttacgatgaatgaaattttgacttatatgaaacagcagacggagccgctttcagctgaagaagccgccaaagcgctcggaatcgcaagggtgacggcgcggcgttatcttgattttcttgagaaggacggccagattaagctcgacattcaatacgggggagtgggacggccggttaaccgctacaaattcgtccgctagccgagaccaaaaagaccaaaatgtccgttatgatcataagcttcccctcttcgtatgaaaacgctatcatttttgtatagacgcagcgagaggcaagggggagtaggaatgaaaattttcaaaaatcttacggtgcaggtcatcacggcggtgatcatcggcgtcattgtcggactcgtttggcctgaggccgggaagcagatgaagccgctcggcgatacatttatcaatgcggtaaaaatgattatcgcaccgatcatattcctgacgatcgtgcttggcatcgccaagatgggagacatgaaaaaagtcggcaaagtcgggggaaaagcatttatttattttgaagtcgtgaccaccattgcccttattatcggacttctggtcgtcaatatcatgaaacccggtgagggccttgattacagcaagcttgaaaaaggggatgtctctcagtacacccaaaacgggggacaggggattgactggattgaatttatcactcacatcgttccgtcaaatatggttgacgctttcgcaaaaggcgacattcttcaggtcttattcttttctgttttattcggtgtcggcctggcggcgctcggtgaaagaggcaaaagcattattgatttctttgataaactgtcgcacgtttttttcaaaatcatcggctacatcatgcgcgcggcgccgatcggcgcattcggggccatggcctatacgatcgggcacttcggccttgattccatcaagccgctggcgagtctgatgctgtctgtatacgttacgatgttcctgtttgtatttgtcgctttgaatatcatttgcaaactattcggtttcagcttgtggaactatctccgttttattaaagatgaactgctcatcgttctcggcacaagctcttctgagtccgtccttccgcggatgatggataaaatggagcgttacggctgttccaaatcggttgtcggccttgtcattccgacgggatattcttttaacctggacggcacctcgatttatctgtccatggcgacggtttttctggcgcaggtgttcggcgttgaccttaccatcggccagcaggttacgatcattctcgtgctgatgctgacatcaaaaggcgcggcgggcgtaaccggaagcggatttatcgtgctcgcctccactttatcggcgcttcaggttattccgctggagggactggcgctgctcctcggcgttgaccgctttatgagtgaaggaagggcgatcgtcaacctgatcggaaacggaatcgccaccatcatcgtagccaagagcgaaaatgagtttgacgaagcgaaaagcacacaggccgtaaaagaaatgaaaacggcggtataaaaggaaaggaacggcatgcatccggcatgccgttctttttttcggccgccatgagtaaaaaagataaatttgtttaaatttattaggaggtggacaaagaccttagcgtcattttgttatataatttacaattagagagtgaaagatgaaatctaagggctttttgtcctagcaggagtgtataaatggcggctatttttaaattttttcagcatccgggtgtcagacgtttttccgtttttcttgttttgactggggtgttagttgtattccgaagtatgattaatttgattttgcttacgtttatttttacttttctgatggatcggctggagactgtcatccggcacgtgttgaaccattttttccggatcagccagagggtggtcatcaccattttatatattgcgctggctgtcggggcgactgtcggaggctttgtcttttacccgattgttgccaagcagattgaacagctgattaagcagatcaagcacatcgcgtatcatcccgatgtcattccgttttatgatgagatatcgagcgtgttcggcgatatcaatatcggttcctatgtaaaagaaggttttaatgtactgtatacatacttggccgatatcagcactttcggtttgcaggtcgtgatgtcactgattctcagcatgtttttcctgttcgagaaaaagcggctcacggagtttatgaaaaaatttcagcacagcaagctgtctgttttttactacgaacttgcttatttcggcagcaaatttgcgagaacattcggcaaagtgcttgaagcccaatttattatcgcgctggtgaactgtatcctcaccttgatcgcattggcgattctgcattttccgcagctgttcggcctgtccatcatggtctttttcctcgggctcattcccgtggcgggtgtggtgatttcgctcattccgctcagcatcatcgcgtatacgacgggcggcgctgtgtacgtcatctacatcgtgctggtcattttcgtcattcatgcgattgagacgtacttccttaatccgaaactgatgtcagcaaaaacggaactgccgatcttttttacctttacggttctgattttctcagaacatttcttcggcatttggggcttgattatcggaattccgatttttgtgttcctgcttgatattctggatgtcgtcaataatgaggagaaggaaaaaaacggaccggtcccggataagacataacgacggctccggctcttcacgaatatatgactaatgttataatgcagacagtgcctatgtacgggcactgtttattttttgtgaaaaaggaggaaggctgtatgactgagccgattttacatattgaaggccttgacaaaacaataggcaaaaagcacattttaaaaaacatcagcatggatgtcaggcagggcgagatcatcggtttgctcggtccgaacgggtcgggaaaaaccacacttatccgaatcatcgtcggccttttaaagaaaaacagcggcacgattacaattaacggctttcagcacgatgctgatttcgaaaaagcgcttgaatccgtcggagcgatcgtggaaaatcctgaattctacccgtacctgacggggtgggaaaatctgaagcactttgccaacatgcacaaaaacatcaaagaagacaggcttcaggaagtcatcgagcgggtcgggctcacaaatgccgttcatgacaaagttaaaacgtattcccttggcatgcgtcagcgtctcgggattgcacaggccattcttcaccgtccgaatctgctcattttagatgaaccgacaaacgggcttgatcccggcggaatgaaggatttccgcgatcacttaaaggaactcgcggagcttgaagggacgagcatcctttttgcgacgcatttattgcgtgaagtggaggacctttgcgaccgtgtcatcatcattcaaaaaggtgagatcaaaacagaggttgttctgcgcggcgctgcggaaaaagaagaaaaagccatcctcgacattcagccggctgacgaagccttcgaatggctgtcccagcagcaattcgttccggagaaaaacggcgggagcattaccgtcaccgtagcgaagaaggacatcccggcattaaaccgtgcgctcgtcggacaagactttctcgtgtattccatcatgccgtatgcggaatcactggaggatgaattcatgaaagtgacgacggcgcttcaagaggaggggaagacgaatgtttaaattgacagcgaatgagcatatgaaactctttaaccgaaaagtctcattagtggcgctgattctgatggccgttctccaatttattatggcgcttgtcattaaacggcttgtcatcagttccggaacggatgagaatttcatcggctatatggcgtacgcccccgggctgaatattctgcttgaggcattaacgatcgtgatcgcgggaacgatcatttccgctgaatttgataagaaaacgatcaaatttttgttaatccgcccggtaaagcgggagcggatttttgtatctaaactcattaccgtatttttggtcagcttgtacctgtatgcggcgtactatattctgtctctgctgttcggcatggctttcttcggagtgtcggtgacatctgaatcagggacgcttcttgtgaacaccctgaaagtaatcggcacgaactgggtcgaggcgtttgcgatggcatgctttggcttgttgtgttcttctgtattccgaaacagcgcaacggccgtcattttgtcatttatcgtgctgtacggcgcaaaatcacttgtgacgattatgtcgctcttccaaaataaatggggtagttttctgctgttcgcaaatactgacctgacgcaatatatgagcggggcgaagccgctgtttgcgggaatgacgccgttattttccgcaggcattatcattatccatatcgtattcttcttagccgtcgcttggtggagcttttgcaaacgcgatgttcgggtataaagtaaaggaatgacatttttgtgaaaaagatcacgataaatcaataatttatgctattttgatttataataaaggtaatgacggaggtgctcacttgagaaattttattaccgcattaccgattgtgttattgcttggtttttcctttgtgtcattcatgtttcaattcgaacatcttgtttatttcaggcttgcgctgggtttgttttctacagtggggctgtttctcttatataaaatgaagacgggattccgttatttcatcatctacctgtatgcaagctggatcgtgcttgcggcggttaccgcgtttgaagagccgattttttcaagctttttctttggcgggcttgtgatgacgatgggttatctcacatatatgctgatttatctcgggctcaagcaggaccgcggcccggaagcagtctgaacgcgctattctatgggatagcgtgtttttttgtacagccttacagttgcgaaacgagacttgaatctctataatacttattaactttatcggaattataatggggggattccagtgtctttatggatacagaatgaacggcagcgggaatggatggaaaaaatcggcctgcttgcagacgaatttcaaaaaacagccgcgcttgatgacgaggcgggccgttttcccgcggagaaaattcaaagactgcgcgacgcgggatatacggcgttaacggtacctgaggcattcggcggtgcaggcatttccgtttatgagatggtgctgtttcaggaacggctggcgcggggagacgcggccgtcgctctcggaatcggctggcatttatccgtcatgggtgagctcggagaaggaaacagctggaatgaagatgtcttttcatttatcacaaaagaggtgaaaaagggagccgtcctgaacagggcagcgacggaacggcagaccggcagtccgacgaggggaggaagacccggcacttccgctgtcaaaaaagacggaaaatgggtgctgaacggccgaaaaacctttacaaccctttcgctgactttggattatatgcttgtgacggcatggattgaagaaaaacaaacgaccggtgtttttctcattcataaagatcaggcaggcgtttcagtcgaagaaacatgggatatgattgccatgaaggcgaccggaagccatgatctccttttagatcatgtcacggtcagtgacgagcggcttgtggagcttatcagcgggccgagagcggcgaaagtgaatggctggctgcttcacattcccgctgcttatctgggcatcgctcaagcggcaagggactatgccgtccggtttgcatctgaatattcgccgaacagcctgaacggaccgattaaagacgtgccggccgttcagcagcgtgtcggggaaatggagcttgaattgttaaaagcgagacagtttctcttcacggcggcgcaaatgtatgatgacccgaaacgccgccctttcatcaaaagcgagctcggcgcggctaaacatattgtgacaaatgccgtcctttctgttgttgacaaagcaatgagaatcaccggcgcaaaaagcctggagcgaaataatccgcttcagcggtattatcgggatgcccgggccggccttcacaatccgccgatggacgatgcggtcatcggcaaattagcggcggaagcctttgagcaataaaaaaaagagcctgaaaaaggctctttttatgtatggctgttgtgccggagcagtttttgatgcttgcggtcaattctgtcatagatcacattcatcagcttttgattattcataatggccgccttgttttcttttatcagctgttcgtatgtttttattttacgtttcgccatgagcccgcaccttccttacatatttgtattcgctttctaattctccgagcgataattcatataaatgccgttccgactttttgtatattccgttattgatcagcaaatggatcagatgtttttttcgtccttcaactgatgatctgagctgaggagaagacctcatgattaccctcctaatcaaatgatattgagaatcattatcagttaatgaaagtatacaatggacatattcatatgtaaaggaaaaataccgccaatttttcgacaaatagtttcccggggaataatgctgtcgaatattgcatttggtcagatcaaagctgctatttttccgcttttccatccatactatgaatgagaatggaggagtccttacatgaatgatcaaacggcaaacttaaaacggggcgaaaaaggcgcgattcttaatatcgccgcgtacctcatccttgccgccgtcaaactggtgatcggtcttatttatcattccgaagcgctcagtgcggacgggttaaataatgccacggatattgtcgcatcactggctgtgctgatcgggctccggatttcccagcgccccgcggacagtgatcatgcctacggacattatcgggctgaaacaatttcttcattaattgcgtcttttattatgatggcggtcggtattgaagtgctgatcggaggagcaaaggcgattgtcagcggaacggaggccgagccgagcttcattgcggcatggacggcgctcggaagcgcgattgtcatgtacggcatgtatgtatataacagccgtcttgcggatcgggttaaaagttctgcgcttcatgcggcggcgaaagacagccgttctgacgcctatgtcagtattggggcgttgataggcgtcttaacggcccggcttcatctgccgtggattgatccggtcattgcctttctgatcggaattatcatctgtaagacggcatgggacatcttcaaagatgcttcccactcattaacagacgggtttgatctgaaagatttggagccgtataaacacacagtgaaagaaataaaagaggtcagcaggctgaaggatgtgaaagcaaggtatttggggagcacggttcatgtggaaatggtcattacggtagatccgggactgtctgtgaaagaaggccatgaagtagccgatgaagtcgaatatgcaataaaacatgaacatgatgtgactcatgtccatgttcatgtagagcctgaagtcataaacaaagatcgtgaaacgaattaaatatgctgtgataaaaactctgtgacttcttcgggcgttttcgcgtttgcgctgtgaagatgcgctttcttttcgccgtttttaaagatcagaaggctcggtatgcccattacctgatatttgtcggcaagctcagggagctcgtctctgttcagctcataccaatcattttgattatattcttccaaaatatcgccgatgaacatattcatgcgcgtgcagtcagggcaccaatcagcgaaaaatttcacgatgatttccttgtcggattgaataagttcattaaattgttctgttgtactgatttttttcatatgacacatctccttttccatgccattttaatataaaataaaaaggaattacatacaaatgctttcatattcagaatgcccaaaaataattagatcattttctgaggaaagtgataagatagtaaagatgaattgttgtggggggaatatccattgaaaacaagtctaggattggtgtacggcggaaagtcagccgaacacaatgtatcgctgcagacagcattagctgtaacaaaagcgcttaatactgagaagtttgatatacatccgatttacatcactgaaaaaggagaatggcaaagaggcccgctgctgactgagccggtttccaacgtgaaaatgcttcagctggaacaaaacggtgaaagtttcgctctatcagcattgaaccgggaaatgtttccagaagcgtcgcctgacgaaaaggcgccgatcgatgtcgtatttccgcttctccacggaccgaacggtgaagacggcacgattcagggtctgctggaattgctgaacgttccttatgtcggcaacggcgtgcttgcatcatcagccggcatggataaagtcatcatgaagcatttgtttgctcaagcggggcttccgcaggcgaagtacgccgcttttttaaaaaaggactggaaacagacgccggacagctgcttacagcaggttgaagaggagctgggatatccgtgcttcgtcaaaccggcgaacctcgggtcaagcgtcggaatcagcaaatgccgaaaccgcgaagagcttgaaaaagccttcgaactggcttttgagtatgaccggaaaattgtggtggaagaaggaatcgccggcagagaaatcgaaatcggcgtactcggaaatgacgaaccgaaatgttccgccgtcggtgaaatcgcgccgaaaaccgacttttacgattacaaagcgaaatatgaagacggcgacacggatttaatgattcccgcgcaagtgacggatgaacaatatgcggaaatcagcgagatggcgattaaagccttcaaagcgattgacggatcaggccttgtccgcgccgatttcttcctgaccaatgacggtcaagtgctcattaacgaagtgaacacaatgccgggctttacgccattcagcatgttcccgctgctttggaaagaagcaggcgtagattacagtgatctgatcgaacagctggttgagctggcaaaagaacgccatgccgaaaaacagctgattaaacatacattttaatgaagacggacactgcctgaaggggtagtgtcttttcccgtaacagacaacattttcagaaagcgaggtgccacctttgataaagcgaactgtaaaacgaatcgccgacatggtcaaaggcacactgacaaatcctgtatttgaacaaacaatgattgagggcgccgcaaccgatacgcggactttggaaaaaaatcagctgttcattcctttaaaaggcgagcattttaacggccacacttttgtgccgcaagcattcgaaaaaggcgtttccgcggtgttgtgggaccgctctgaaccgaatccgccggaagagcgtgctgtcatccttgtcgatgacacgctggaggcgctgcagacattggcgaaagcttatttgaaagaactcggcacacgggtcatcggggtgaccgggagcaacggaaaaacgacaacgaaagacatgcttcacgccgttctcggcactcagtaccgcgttcacaaaaccgccggcaatttcaacaaccatatcggcctgccgctgaccgtgcttgccatgcctgaagatacagaaatcgccgttttagaaatgggaatgagcgcgagaggcgaaattgattttctgagccgtcttgctgaaccggaagctgccgtcattaccaatatcggcgaatcccacatgcaggatttaggctcaagagaaggaattgcggaggcgaaacttgaaattataaacggacttcgggaagacggcgttctgttttatttcggggatgagccgctgctccgcgaaaaggcgtacacttgccggacaacgacatacggcgcaggcgctgacaatgatctccgcctgaaagaaataaaacaggcggaagaaggcacgtacttcaatatcgacgggatcgaacgttctttctttattccggttctcggcagacataatgtgatgaatgccatggccgcatacgccgccggcatctatttcggcattacgccggaaaatgccgctctgggactgagccgcctgaaggtgacggggatgagattggaactggttaaaacggaaaacggcatctcgatcgtaaacgacgcgtataatgcgagcccgacgtcaatgaaagcggcggtcgaattaatcgaaacgatgaaaggctatcggaagaaaatgctcgtgctcggtgatatgcttgaactcggtgatgaagaaaaagcattccacgaagaatgcggagctgcgatcaatccggcggaaattgaccatgtatttacttacggcacactcggcgcattcatcgcagacggagcgcgccggcattttgaagaagggcgcgtcagccattatctcgacaaaaaagaactgcttcacgccatacaggatatggccgcttccggcgatctccttctgtttaaagcatcgagaggtatgaagctcgaagaaatcgttaaagatttattagagaagaactgaaaaaatactgatcagcattataaaaatatacaaaaatgaagaaactaattcagggtgaaataattctgtccgtatgaaaaagaaaggccgccggctgggaaatcccgtccggcgcggggtccggcctcgtttgcgggaagaatccggtcaggccgcttccggccgcctgaccatctcgccttattgaaaaacacatagtgtaatggtaagattaaacgtaaagtaattcgggctttgtatacgtatgatcctgtcctttggatgaaagggcagtttttagtggtaaatcacgacattactgaaacagcaatcagaaggagtttgaataatttgactataacgtttcaagatttccaattaagttctgatctcatgaaatcaatcaatcgtatgggatttgaagaagcaacaccgattcaggcacaaacgattccgctcggacttttaaataaagatgtcatcggacaagcgcaaacaggtacaggtaaaacagctgcgttcggtataccccttgttgaaaaaatgaaccccgagtctcctaatattcaagcaatcgtaatcgcgccaacccgtgaattagccattcaagtatctgaagagttatataaaatcggacaagataagcgtgcgaaagtgctgcctatttacggcggtcaggatatcggacgtcagatccgcgcattgaagaaaaacccgcatatcatcgtaggtacgccggggcgtcttcttgaccatatcaaccgccgcacgatccgtttaaacaacgtgaacacggttgtcatggacgaggctgatgaaatgctgaacatgggattcattgatgatattgaatccattctctcaaacgtgccgagcgaccaccaaacgctcttattctcagcaacaatgcctgcgccgatcaaacggatcgcagagcgtttcatgactgagccggaacacgtaaaagtaaaagcgaaagaaatgactgtgtccaacattcagcaattctacttggaagtgcaggagcgcaaaaaattcgatacgctgactcgtcttcttgacattcagtctccggaacttgcgattgtattcggccgtacaaaacgccgtgttgacgaattgacggaagcgctgaaccttcgcggatatgcggctgaaggaattcacggcgacttaacgcaggcgaagcgtatggtagcgctccgtaagtttaaagaaggtgcgatcgaagtgcttgtagcgactgacgttgctgcccgcggacttgatatctcaggtgttacccacgtttacaactttgacgtgcctcaagatcctgaaagttacgttcaccgtatcggaagaacgggacgcgcaggaaaaacgggtatggcgatgacgtttatcacaccgcgtgagaaaaacatgcttcgcgcgatcgaacaaacgacaaaacgcaaaatggaccgcatgaaagagccgacgcttgacgaagcattagaaggtcagcagcaggtgacggttgaccgtctgcgcacggcgatcagcgaaaacaacctgaacttctacatgacggcagctgcggaattgttagaagatcatgatgcagtgacagttgtggctgcagccatcaaaatggcgacaaaagagccggacagcacgcctgtacgcctcactgatgaagcgccgatggtcagcaaacgctataaaaaccagcgtacttctaagcgcagagacggccaaggcggcggctaccgcggcggcaaagggaaaaacaacaaccgttcttcctacgataaaaaacgctcaagcgaccgccgttcttcaggtgacagacgccagaaaaaatcatactaaaacacaggaagcggacccttttacggggtccgcttttttttgatatgccggaaagtgaatcttttttgcaaatcagccgtatttgtatgtatgataaaaaatgggaggtaggtatgttgagagcacagccaaaaaatcgaatcagtccaagcggcttaaaagtctggcgtcttcaggaaatcatcctgtccgccttctgtcttctagccgttatagcagcagctgttttaagccatttcttccattggccgtattggatcaccggagtcctcggcatcatttgggtcatcggttcagtgatatccgtctatgccataccgaaaatcaggcacaggatctggcgctatgaggtccatgaaaatgaaattgatattcaatccggcatttttatagtcaaacgggtcattgtgccgatggtgagggtgcagcacgtagatacttcacaaggcccgctcctcagaaggtaccgcctggcctcagtcaaaatctctacggcggctaccgttcattccattccggcgcttgatatggaggaagctgaccggctgagggattccatttcccgtctggcaagggtgacggaagatgatgtctgagccgaaacgtctgcacccggcagccgtgattttgaacttattccatattattatcgaaaccattaaaaacattattctgccattttttctcgtctatattgttaattccaaccacttcatccgcttttacggaggcattgcgctcgctgtcctgcttgtctggctgattacggcaagtgtgatcgagtggagaaaatttacataccggattgaggacggagaattcagaattgaagaaggcttgttttttacgaaaaagagatacatctccattgaccggattcaatcaatgaatacgagtgccggcatcgttcagcagctttttaagcttgttaagcttcaaatcgaaacggccggcgacgggaaaaacgccgaggctgtcttatccgccattactgtggaagaggcggaacggatcagagcggctgtttttcagcaaaaagcggagcaagaagaacgaggggagaccgcagcggagcaggagccgatgcgcggggaagatgtgcaatccgtttaccgcctgtctgtgggtgagctgcttatggccgcctcaacatccggggggatcggtgtcatcatctcagcggtattcgccctcttttctcagcttgatgaagtacttccgatggactggctctacgacaggttttcttttctcaagcatgcgagcatcggcatatacgccgtgatcattttcataggattgttcatcgcctggctgttaagcatcgccggtatgatgatcaagcatgccaactttaagatagaaaaaaaggaacacgaattggtcattacgagaggaattattgaaaaacatcaagtgaccatcccgctccgtaaaatccaagccattaaaattaaagaaaatgtaatcaggcagttattcggatacgcgacggttgcgattgtcagcgccggaagtgcggggaatgagaaagaaggagctcagacgattctgtttccgatcatccgcaaatcaaagctcgttgtgatgctgaacggtttcacaccggattacgtactggaagaaaaccggaatcatttgccgaaaagggcgctgcgccggtatttattccgctccgttatcttctcggttttcgtgatcattccgctttgtattctgtttaaaccgtggggatatgcatcgctccttgtgcttcccgtcgaactggtgctgggctacgcctcatttaagagcgcgtcatggtgcttaaacggaggccggctgcagctcaccacacggctgatcgggaagacgaccacgattatgctgagaagaagaatgcagatgtttgaagtcagccgctcctttctgcaaaaaagaaggcggctcgcatctgtggctaccgcagtgaaatcagctcaccacatggagcatgtcatgctgaaggatgtcagcgaggaagatgccgaacgcatcgggcgctggtattcatatgaaaaagcggacggttaataccgccgctttttttgctgcacgcataaaaaggaaagcaaaaatccgcctgccagtccgaacaaatgcgccataatgttaatattagaattgataaacgtcgacagtaccgcgatgataagcagggtcataatcattttcgactggtcccggccgatcagctccttgcggaaaacagtcagaaacacatacacgccgaaaagtccgaaaatcgcgccggatgcgccgacatgcacataatcaagcggttcggcaagatatgtgccgatattgccgataatgcccgatgcgatgtacacaatcagaaaacggacttttccgagcatctgctccagcgggggcgcgaataaaaagagagacatggagttaaacaaaaggtgagtgaaattcgcatgtaaaaacatcggtgtcaccagccgccaccattctcccgaggaaacgccgtaattatagccggtcactgcatctgaccacatcatgacggaatgaagcggcatactgaaaaacagccacaagaacgcctgcagcgccaagatacagctgacggccggataacgtctgataaaagtctggaaattttccgtacgtataaacatcgcaagcccctttgcatctgatttgttacatatatagtaacacgtttatgacataaaccgttttttagtacggacttttaggaggaattcacatgattttcggaatcggaatcgacatcgttgaactgcacagaattgaaaacatgctcagccggcaggcgaggtttccgcaaagaatattgacggaggctgaatacgtccgttttacattgctgtcggacaaaaggaaaattgaatttctcgcgggaagatttgcggcaaaagaagccttttcgaaagcatacggaacgggtatcggcaaagagctcagctttcaggatatcgaaaccggaaacgacacggcgggcaagccggtgctgacctgcgccaagctggacggcgcggcggttcacgtctccattacccatacaaaagaatacgccgcggcacaggtcgtgattgaaaggttgtcacgctagtctgcatattagccgaaaccccttcatatatttgatagtgcattaagggagacaagttgtttgaggcttttatggtacgcgtccgtccgttcagggcgtaccgttaaagtcaaacaagcgatttcttccctttacatcaattgagaagaaggggttgaaaaaaggtgagaaaaagctttgttttgcttttaacgggactgcttgccgtccttattctttcggcctgcggccaaaaatcacaggaagatatcgtgaacggtttagataagaaggcgaaagaatacacctcgtacaaagcgaaagccaaaatgaccattcagacggggagtgatccgcaagtatacaatgtggaaatctggcataaaaaaccttccctgtaccgggtctatctggaaaatccgaaaaaagaccaaaaccaagtcattttacggaacgccaacggagtctttgtccttacgccgtctttaaataagagcttcaggttccaaagcgactggccgaataacagcagccaagtatatttgtttgagtcacttgtaaaggacgtgcagcatgacaaagacgccgtctattccgccaaagataaaaagtacacgtttgaaacaaaaacaaactatcagcacaacaaaatgctgccgactcaggaaatcactttcaacaaaaaggacatgagcccttcgctcgtcaaagtcatggatacagaccggaaagtgatggtaaaagtcgaattcaaaagctttgaattcaacaagccgtttgataaagactcttttgacgagaagaaaaatatgacgctttcccagatggacgtcgccacaagcgccaagccgtctgattcatttgcggtcaaaacaccgcttcaagtgccggccggcgtcaaaaagcttgaagagaaagatatttcaacggcggacggcaaacggatcgtcatgacttacggcggagaaaaatccttcacccttattcaagaaaaagcccatatcgcaaaagccgcctctgccgtcacgctgaaaggcgaaccggttaatctcggcttcacggtggccgcattatctgatacgtctttaacgtggacatatgacggagtggattatcttctgtcatcacaggatctgacaaaggatgaaatggtggccgccgccaaaagcatgcagggacagtcgtcaaaataatgtcaaaaaagaggccgccgctgtcggtctcttttttgattccatttcactttgcagaataattttagtatgataataacaatatgaattgaaaataatgctaggaagtgtatcgaatgaacacagcatccttttacagagaaacgtgggcggaaatcaacctgtccgcgattaaagaaaatgtcacgcatatgaaaaaacacatcgggcaaaacgtccatctcatggcggttgtaaaggcgaacgcttacggccacggagatttggaagttgggaaagccgcgcttgaagcgggtgcctcttgtcttgccgtagccatactggatgaagcgatttcattgagaaaacggggcattacagcgccgattcttgtgcttggcgccgtgccgcccgaatatgtacaagcagctgccgagtatgacgtaacactcacgggatattctgttgaatggcttcaggaagctgcgcgccacctcggaggtgccacattgccgtttcatctgaaagtcgataccggcatgaacagactcggagtcaaaacggaggaagaaatccaaagcgtgttaaaaatcctcagccaaaatcccggtttagtctgtaaaggcgttttcacccactttgctaccgcggatgagaaaaacagagattatttcctcttccagtttgaccgctttaaaacattgatcgctccgctccctttaaaagaattgatggtgcactgcgcgaacagcgccgccggacttcgccttaaaaaaggcttctttaacgcggttcgtttcggcatcagtatgtacgggcttcgtccttctgctgacatccaaagcgaaattccgtttcaattaaagccggcttttgcgctgcactctgtgttatcccatgtgaaaaagatccgcaaaggggaaagcgtcagctacggcgcaacatataccgcagagaaggatcaatggatcggaacggttcccatcggctatgcagacgggtggctccgcaagctgagcggcacgtctgtgctgatcggcggcaaacggatgaacatcgcgggaagaatctgcatggatcaattgatggtcgaattagatcaatcttatccgccgggcaccaaagtcaccctgatcggcagccagaaggaagaaacgatcacgatggatgaaatcgcagggcggcttgagacgattaattacgaggtcccttgtaccattagttcccgcgttccccgtatgtttttggaaaatgagagtataatggaagtaagaaatcctttactgcaagataatacaaacaagtagccgtcatccggaaaaagagaatttataaaacagctttgcttgacgtttgaataatggtatcattatgtctggatggatgaattggtcgtatccgtaagtttggtggaggtgtatgttttttgtctgaatccagcgcaagaaccgaaatgaaaatcagcttgcccgaaaacttagtagctgaattggatggtgtagcgatgcgggagaaacgaagcagaaacgaactgatatcacaagcagtgagagcgtatgtcagcgaacggacaactcgccataaccgtgatttgatgagacgcgggtatatggaaatggcgaaaatcaacttgaatatctcttctgaggctcactatgctgagtgcgaagcagaaacgaccgttgagcgcttagtcagcggaggataatcattttgattgtaaagcgcggcgatgtttattttgctgatttatctcctgttgttggctcagagcaaggcggcgtacgcccggttttagtgatccagaatgatatcggaaatcgctttagcccgactgctattgttgcagccataacagcccaaatacagaaagcgaaattaccaacccacgtcgaaattgatgcaaaacgctacggttttgaaagagattccgttattttgctggagcaaattcggacgattgacaagcaaagattaacggataaaataactcatctggatgatgaaatgatggataaggttgatgaagccctgcaaatcagtttggcactcattgatttttagtcatattttggttgctcatatagagcaactttttttgttttcgaaaaacataagcgctataataaagaaataatcaaacaaaatttgttgttttgtgtcgggaggtcagtgaaacccatgtcgaatcagaaagtgtatcagttcattattgatcagcatgatgaactgcttgatacttggacagccaaactaaaagaagtaggcaatcaggaagactatcagcttacgaatcacatatgtgaaaatatttgtaaagattatatagacattcttttattatcgacaaaaaatgacgaggctacggaagagcagatcagtgaactcgcactgcgcgccgttcagctcggcctgtcgctgaaacttctttcagccaccctgtcagagttttggaaactgctttacgaaacgatggtcgatcttaatatggccgatcaggacagagcagatttgattttggaaatagacagctttttcaatccgatcaacacggaaatcttaaatcagtattctatctcctgggaaaaaacggttactttgcaaaaaatcgcgcttcaggaattgtcggctccgctgatcccggtatttgagcatgtaacagtcatgccgcttgtcgggacgattgatacggagcgtgcaaagcatattatggaaaatctgttaaacggcgtcgtaaagcaccgttcacaggttgtattaattgatatcacgggcgtgccggtcgttgatacgatggtggcgcaccatattattcaggcatcagaagcggtgcggcttgtcggcgcgaaatgtctgctcgtcggaatccgtccggaaatcgcgcagacgatcgttaatctgggaattgatttgtcgcaggttattacgaagaatacccttcaaaaaggaattcaaacagcgcttgaaatgacaaatcgaaaaatcgtttcattgggggaataacattgtgagacatccaaaaatcccgatcctgaaactgtataactgcttattggtatccatccaatgggagcttgacgaccagacagctttgcattttcaagaagatctgctgaacaaaatctatgaaaccggcgcaaacggggtcgtcattgacctgacatccgttgacatgattgattcatttatcgcgaaagtgctcggcgatgtcatcaccatgtctaaattgatgggcgcaaaggtcgtattgacgggaattcagccggctgtggcggtcacattgattgaactcggaatctcacttgaggaaattgaaacggcgctcgatttagagcaagggcttgagacattgaagcgggaattgggggaatagcgatgaacgaccaatcctgtgtgaaaatcatgacagaatgggatatcgtagccgccagacagcttggccgcaacgttgcgaaggaattaggcttcggcacggtggaccaggccagaatcacgacggctatctcagaattggccagaaacatttacttatatgcaggcaagggccaggtcagcatagaacaagtaaacgacagagggaaaaaaggccttaaaattatagcagaagacaaaggacccggaatccccgacatccgtaaagtgatggaagacggcttttcaacgtcaggcggactgggagcgggacttccgggcgtcaaaaggctgatggacgaattcagcctgcaatctgttgcagaggaaggaacagagattcaagccgtaaaatggcttcggtaggaggttagaacgtggatttcagggaggttatagagcagcggtatcatcagctgcttagccgatatatagccgaattaacagaaacatctttatatcaagcccaaaaattcagccgaaaaacgattgaacatcaggttcctccggaggagatcatcagcatccaccgaaaagtggtaaaggaactgtatccggatctgccggaagatgtttttcattcgctggattttttaatagaagtcatgattggctacgggatggcttatcaggaacaccaaagtctgagagatatccagcaggagcttcgttcagaaattgaaattgccgcaaatgttcagcagacgctgctgggcacaaaaattcctgaagaagaagaactggatatcggggcgatcagcgtccccgccaagcaaatgagcggggactattatcactttgtcaaagacaaggaatcgattaacatcgcgatagccgatgtcatcggaaaaggaatacccgccgcattgtgcatgtcgatgatcaagtatgccatggactctcttccggagatcggcattcacccctcccaagtgctgaaaaatcttaaccgcgttgtagaacagaacgtggactcaagcatgtttatcaccatgttttacgcaaactacaatacgaaaaatcaccaatttacatatgcttctgcggggcatgaaccgggcttctactactctgaaaaagaaaaaaagttttatgatctggaggcaaaaggattggtgctggggatttcccaggattttgattacagccaatatgaacagcacatggacgaaggagacatgatcgttcttttttctgacggcgtcaccgaatgccgtaccgaaaacggtttcttagaacgcagcgacattcagcgcatgctggaagaacatatggactgctccgcgcaggatatggtcaaaaatatttacgacagcctgctgagacttcaggactttcagcttcatgatgattttacgttaattgttttgaaaagaaaggtttaaaaaaacggcagcacgggtaaaaagccattagcacgagtaaggataactttcagaggtgatacgatgaatttaacggtagatatgaaggagaatctttcagatatacaaatcaatatcgctggagaaatcgatgtatactcagctccggtggttcgtgaaaagctgatgcccctggcaaacgaggggaaggacatgagaatctgcttaaaagatgtaaactatatggacagtacgggtttaggtgtttttgtaggcgtgtttaaaacggtgagcaaggaaggcggctctctgaagcttgagaatctttccgaccggctcgtccgtctgtttgaaattacggggcttaaggacatcatcgacatttcggcaaagtcagaaggtggcgtgcaatgagtacatcagttgattatatagagatgaaaattccggccgaaccggaatatgtaggaatcgtcaggcttacattatcaggagtcgccagcagaatgggctatacctatgatgacattgaagatttaaaaatcgctgtcagcgaagcttgtacaaacgctgtccagcatgcatacaaagatgaaaataagggagaagtatccgtgcggttcggtgtgtttgaggatcggctggaggtcattgtcgccgatcagggagacagctttgattttgatcagaagcagcaggatctcgggccgtacacaccttcgcacacagtcgatcaattgtcagaaggagggctcggtctgtatttaatggaaacgctcatggatgaagtcaaagttcaaagcaactctggcgtaaccgtggcgatgacaaagtatttaaatggggagcgagttgatcatggcacaaccatcaaaaactacgaaactaactaaagatgaagttgatcggctcatacgcgactttcaaacacatgataataaagaagcccaggaaacactcgtcgaggtgtataccaatctcgtcgaaatgctggcaaagaaatattcaaaaggaaaaagctttcacgaagatctccgccaagtcgggatgatcggacttctcggagccattaaacggtatgatcccgaggtcggcaaatcctttgaagcatttgcgattccgaccatcatcggcgagatcaaacgcttcctcagagataaaacatggagcgtacacgtcccgagacggattaaagaactcgggccgcgcattaaaatggcggtggatcagctgacgacagagacgcagcggtcgccgaaagtcgaagaaatcgcagcctttctcgatgtgtcagaagaggaagtgcttgaaacgatggagatgggaaaaagctatcaggcgctttctgtcgatcacagcatcgaagcggatgcggacggaagcaccgtcacgattttagatatcgtcgggtcgcaggaggaaggatacgaacgcgtcaaccagcagatgatgatcaaaagcgtgcttcatgtgctgtccgaccgcgaaaaacagattatcgatctaacatttgtgcaaaataaaagccaaaaagaaacaggggacattctcggaatatctcaaatgcacgtctcgcgcctgcagcggaaagcggtgaaaaaactgagagaggccttgattggagatccctccatggagctaatgtaatgattcaggttgaagaaaatgaacatgttcaaactcttgtataccaattaaataaagaaggcaagtccatatgcggcgacagcttttttatgaaggcgaatgaagaagaattagtttgcgcggtagcggatggtctcggcagcggatctcttgccaacgaatcctcgtcagccattaaagacatcgtggaaacgtatgcggatgaggatgtggaaagcatcattgagcgctgcaatcaagcgatgaaaaacaaaagaggggcgactgcctccatcttaaaaatcaatttcatcaaaagggaattgacatactgctcgatcggcaacgtccgtttcttcctgcactccccatcaggcgaagtttttcatccgctgccgatttcgggttacctctcaggcaaaccgcaaagatacaaaacgtatacgtcatcatacgaaaaaggggcgacattcatcatctacacggatgggcttgaggttccgcatatccgcacctgcttaaagcagggacactcaatagaagaaatatcaaaatcacttcatccgtacacaacatccagacgtgatgatttgacctatattctcgggcagcttttatcgtaaggctgctttttttatgttccgccgttttttgatacactagagaaagaaagaagagatggaggcttttgtgatatggaaacgttagcccttttgaaaaaacaaattgctgaagaaacagcgttatcccaaaaacatgtcgaaagtgtcatccgcctgctggaagacggcaataccgtcccgtttattgcgcggtaccgaaaagagcagaccggctcaatggacgaggtgcagattcaggcaatctccgagcggtggcaatacatacaaaacctgacgcagcggaaagaagaagtcatcagattgatctcagagcaggacaagctgacagacgggctgaagcaaaaaatcgagcaagcggtcaagcttcaggaagtcgaggatttataccgccccttcaaacaaaaacggaaaacaaaagccaccgtcgccaaaagcaaaggccttgaaccgcttgcggactatattctttctctcccgaaagaaaaccgccttcacgacgtcgctgatcaatatatcagtgcagaaaaagaagtcgcttcaagagaggaagccattgaaggcgcgaagcacatcatagccgaacaaatctcggatgatcctcatttcagaaagtggatccgccaggaaacgtataaaaaaggaattctcacttccgcagcaggcaagtcagccgcagatgacgagaaaaacgtctatgagatgtactacgagtacgaagagccgatccaaaaggtcgttcctcacagagtgcttgcaatgaatcgcggtgaaaaagaaggcattttaaaggttgcgatcgaaccgcccgccgatcagataaaagcttatttagaaaagcaaatcatcaaacaccgtgaaacacctgtgaaagaaacgctgaaagaagccattgaggacagttataaacgcctgatccagccggctattgaacgcgatatccgcaaagagctgtcagaaaaagcagacgcgcaggcgatccatattttcgctgaaaacctgcgtaagctcctgctgcagccgccgatgaagggaaaagtcgtgctcggcgtcgatccggccttccgtacggggtgcaaacttgcagtcgttgatgagacgggaaaagtgctgaaaatcgacgtcatttacccgcacgctcccgtcaaaaagacagcggaagcccggaaaaaaatcaaagaattgctggaccggtacaaagtcgaggttgtggcgatcggaaacggcacggcatcacgggagacagagcaattcgtcgttgatgtgctgaaagaaacagagcgggacatttattatgtcatcgtcaatgaggccggagcaagcgtgtattccgcgtcagaaatcgcccgtgaggaatttccggattttcaggtcgaagagcgcagcgccgtctccatcgcgcggagattgcaggacccgctggccgagcttgtgaaaattgatcctaaatccgtcggtgtcgggcaataccagcatgatgtcagccaaaagcatttaaacgaatctctccgttttgtcgtagagaccgtcgtcaaccaagtgggggtgaatgtcaatacagcatcagccgcgctgcttcaatatgtagccgggttatccaaaaccgttgccggcaatatcgtcaaaaaaagggaagagctcggaaaatttacaaaccgcaaagagctgaaagatatcccgcgtctcggcgcaaaaacatatgaacagtgcatcggctttttgagagtgcccggaggacgggagccgctcgaccgcaccgggatacacccggaaagctataaagagacaaaggcgctgctcaaaaaactgcagctcactgcggatcagatcggaagcgcggacgtcaaagagaaaataagtgcattgccgctgtctgaaacggctgaagagctcggtataggggagattacgcttgcggatatttgcgggcagctgacaaggccggagcgagatccccgtgacgaagtgccgaagcctttgctgaaaaaagacgttctgcagcttgaggatttaaaggaaggaatggaattgcagggcaccgtccggaacgttgtggacttcggcgctttcgtcgatatcggcgtcaagcaggacgggcttgtgcacatctcaaaactgagcaatcaattcgtcaaacatcctctcgacgtcgtatcggtcggagacatcgtcaccgtatgggtcgaaggggtggacgtgcaaaaaggcagagtgtcgctgtctatggtaaaataaaagcactgcttacgagcagtgtttttttctgtagaaataccagcactggttcagcagtttgatttggtaattgtccttttctaaaaacgctttttgcatttgtttcatcagccaattcggcatggctcattcctcctcagcttttagttagaggtcggttttaacacattgtatgcgaacggtgaattgtcccgttcaatgtttttaaagcggggtgcacatatggataacgaacaacttcaaaagctgacggaagacatctctgcacaggatttcggaaagccgttccgtcaccgggcctttttcaatgaccggctgaaaacgacaggcggccggtacatgctgtcttcccataacatcgaattaaaccgcaaatatcttctcgaacacgggcagagcgagctgataggcatcatcaaacacgagctgtgccattatcatcttcatcttgagggaaaagggtacaagcacagagacaaggatttcagagacctgcttcagaaagtcggagcgccaagattctgcacgccgctgcaaaccaaaaagacacaaaagaaaacatatatgtatagatgcgaggcctgcggccaacagtatataaagaagcgggcaatgaacccggaaagatatgcctgcggaaagtgcagaggaaaaatcaaaagaattttttaaaaaggcttgactcatttcaatgatctgtgttaaattataaaagtcgttgagagacaacgatgctttctcaaaaaaataaatgttgcttattgacacaatatgtcgcatcatttataataaagaaagtctgatcattccacagtagctcagtggtagagctatcggctgttaaccgatcggtcgcaggttcgaatcctgcctgtggagccattatggagaagtactcaagtggctgaagaggcgcccctgctaagggtgtaggtcgcgtaagcggcgcgagggttcaaatccctccttctccgccagataagttctcaaccagacggcccgttggtcaagcggttaagacaccgccctttcacggcggtaacacgggttcgaatcccgtacgggtcaccatttaccttcgttgggctatagccaagcggtaaggcaacggactttgactccgtcatgcgttggttcgaatccagctagcccagccattttatttaaaaattttgaatcacttttagagcgagccattagctcagttggtagagcatctgacttttaatcagagggtcgaaggttcgagtccttcatggctcaccacttgtcacgcgggtgtggcggaattggcagacgcgctagacttaggatctagtgtcttacgacgtgggggttcgagtcccttcacccgcactttcttttcaaagtgctgatcatcatcactagcttatatgcttagtggaaagacagcttcatagcacgcggtcgtggcggaatggcagacgcgctaggttgagggcctagtgggtgaataacccgtggaggttcaagtcctctcggccgcatcccaatgataccaagggtttaactacctttggtattttttgtgcttatttttaaatgatctactatccacaaactgcccacttacctggagtaagtcatctacagtttacgtcgcgcaaaatattttcatcattataggtagttactaatgcctcaaactccaatttgcaaaaggcagagaaagtattgctaagcatggaggaaaacaaagaggacttgttatattatcagctattagaatttagacacgagataatagggtaggggcataaaggtactgaaaaggcttaatcttttttaaaaggttaagtctttttttggctataaatgtaatctgtgcccaattatttgccctgaattcacgaaaaaggataaaataggtgtaaataaagttgctattttaaaattagattcaattcattatcgcaaaagcaataataactaatcggcgaagaaaggataatcagtcaaatgaaaacattagttatcgttatacaccctaatttggaaacgtctgttgtcaacaaaacctggatgaatcgtttaaagcaagagaatgacattacggttcatgatctgtacggtgaatatcctaattttatcattgatgtagaaaaagagcagcagctcctgttagatcatgagcgcatcgtttttcagttcccaatgtattggtacagcagtcccgcgttactcaaacaatgggaagatgatgtgttaacacatggctgggcttatggaactggaggtactaaattgcatggaaaagaactactcttagctatctccttaggcgcacaggaatctgattatcaagcaggcggagaatataatatcacgatcagcgagcttatcagaccgtttcaaatcactgctaactatataggaatgcgttttcttcctgcctttgcacaatatgggacacttcacctttcaaaagaagatgttaagaacagtgcggagaaattggttgactatcttaaagctgagcattgatccggtattcgcgagggaagctgaaataaactaattacagcagggcgatgagtagatatttcttgttgaaatgtagatttccttggtctctaataggtgcccagtttgtgctcagaattcatgaaaaatgatgaaaataagtataaataaaataaacagatgctttgaataaaagcttttgaaactcatgataggtttttactaggttgagggcccagcgggtgaataacccgtgaaggttcaagtcctctcgccgcatcccaatgataccaagggtaatagagagatccttggtatttttttgtgcttatttttaaatgatctactgcccacaaactgcccacttacctaaagttcaaagtgatcaaaatactcaaagtatctggacaatactttgcttggttcttatttgtcgatagtcgcagtaacgaaagcactaaacaacacattaaacagattcttttgatatgacggacacatatgacagtttgcgattgtcgaaattcaatgtataacccttgttcaacttaccaagttcagttaaaagtttgttaaaattgtgataaatgtaagaaaggattaaatgttcataccgaaacattaggattaaagggaaggggaaacaaatacatgtcgatttaccataaagtaattggagatggatatccgatcgttatgttgcatggttggacacttgaccatcaggtgatgttaaatgcaatggaaccgttattcgagaaacgaagcggttggaagagaatatacatagacttaccaggtatgggacattctaagccacaaccatctattcagaactctgatgatgttttagaagcgatattgcgtcttttggacgagattattcctgatcaacagtttattgtttgcggtaattcatatggagggtacattgccagaggtatcgttcgttcacgtaaggaaacagttcgtggattactgctgatggcaccattaactatacccgaattcgatgaaagggtagtaccgcagaagactgttctaaaaagagacagcgacttgatatcacatttgtcttcagaggaggcggatgaattttgctctatggggattgtgcaaggtaaaactgaatgggagaggtttcgggatgaaattttacttccatctaaacaaacaaattatgaattcgtaaacaacattcgtcaaaatggatatgggtttaccttcgatatttcatctaaacttgagtatcccacgctaattatcacagggcgtcaggacaatgtagtcggataccatgatgcgtggcggctactcgaagattacccaagggcaacttttgcagtacttgatatggctggtcacaacctgcaaatcgaacaaaccgatgtatttaattcattggttcacaactggttaaacagacttgagtcggaaaattttcggttggtataactttccataagcgtgagtttactgttgcaattaccaattagttaaacaataattaagataagcaatattggggtttcctgaaattttagtaattattagtctttattgtcattggggatcatttaatcattgaacaaaaataaatccattatttcataccctgtgctacttatttctgttgtagtctgtatactgattaataggtaaggaaagtcgaaaaggtatacgaaattcgtcatacaaattaaagttttgaatgaaagagcaggattactcctgctctttttctttctaattgggctagattaaacgcagacggttattccttgggaaaaacaaaaaaatttcttctatccattgactagcttggctttagcctggtttctatcaccccgttgggcttgtcaggttttaaaaaggtatgctacgtttatagtgttttgtttcacctgattgtggggtaataaagatagaatcagtaaataattcttaggaacgacctcaatcttataataaacatattggaagacgtaatggaagatctaaaataaaggtttaggctactttgaagaaataaaagttttttttcgattgtgatcatattcacaatagagctgtatgaaggggaatcatttctccaaatcgtctgcagaaaataccgaccacagcccaaggatatctcactaaccgcttaggctggtattatctgttggctgtttctctttttgttgcttcttgtattatttttagcccaatcggcaaaaataagttaaggaaaccagcgaaaacacttaatttcatccttctttcctggtttacaatgttatttggcgctgatatggatattagtctagtcttgtaaggtacagttgaaccaatcagccactatgccgttagctctccatcaggtgaaacagaaacccccggacttttagagaagcattacgctatacattctgggactgcatgctcggaccgtttacgcgcttgtataatgtggatttgataattaaggagtcgatattattaaatgaagtttaacaagaaaaaaattaacgttgtagacattcaaaaagcgaagaaaagcgtgtttgctacagggataggaaacgcgatggaatggtttgattttgctttatattcttatttggcagttattattagtaaaaactttttcagtccagttcaaaacgatgaattaaagttaatatttacttttgctacatttgcaattgccttcttacttagaccggtaggcggaattatttttggtaaaatgggtgataaatttggtcggaaaatagtattaacaattactattttaatgatggctttatctactttaataattggtgtgcttcctacctatgatcagattggggtatgggcccctatattattactctttgcccgtattctgcaaggcttttctgtgggtggagagtacgctggggcaatggtatatatcgcagaatcttctccagataataaacgtataaggttaggcagcggtttagaaatcggcacattatctggttatatagtagcttctgttttagttacagtacttttctggactttatctgatgttcaaatgaatagttggggatggagaattcctttcttcttaagtattccaataggattatttggtttatatttgagaagtcatctagatgaatcaccaatctttgaaagtgacatctctgaaaaccaagaacaacaaccaggtttattagaagtcattaaaacatataaaaaagatatctttttatgtatcgtatttgtggcatttttcaatataaccaattacctattattagggtatatgccttcttatttagatgagaaccttggtataagtgataatataagtacaccggttacagcaattgtattgattattatggtaccgttcgctttaacttttggtaaactgggagataaattaggaaataaaaaagttataacaattggattagtattaggaattgtattttcgattatctcttttcaatttcttaatatggggaatataacattcttatttataggacttttaatgttaggtatagtattatctgtatacgaaggtactatgccaggatctttacctacgttgttccatacggacattagatatcgtacattatcctggacattcaacttatcagtttctatttttggcggaacaacacctttagttgcttcttggttaacccatgtgacaagaaacaatttggcgccgggtttctatttattggcagtcagtttaattggcttaatagttgtgttaaccttatttaaagatacttcaggtaaatctttaaaaggttcttacccaacagttgcttctaaagctgagtttcaagaagctgttgaaaatccaaaagattcactgtggtggaaaatggaacaaacagaaaaggaatgaaaaaaacatccatttaattgaccgactactcgaaatacagactcagaataagctgggattatccgagcagcaatgactgcagctcttttatattctggagggcttactgctttgcaaatgcagcgttgctattctcgatcgtcattattttattggttgtgtcctaataataaaacattgacgcaagaacgaagagaaattaaaaggtccgggcaatacagcaaaataagaagcaagaagctttgttatgccggttcttctcccgaaggagagctggctttttattttctgtatgaggtccaaagcagaaaacgagaacttgtacgctaactaatcaacaaaggttttttggatatgaagagggcgaactggtgaaaaaatggagtttgttgtggagttagcttttcaattagggacatctcaacaacaaaataataaccagcccgattaaaaagctcatcaaaagttccattattccaatatacgatccactcaattatttgagtggatctgtttgttttttatttatttgcagcagtctctatgtgacgaaacaataaatggattaaaaccctttacgcagccaggttgcggcgagatcaattgctccgcgcgcagcttcagttttagctaaggcgttgagcatcacgaaatcgtgaatgataccttggaaacgtacggcagtgaccggaacaccagcttcacgaagtttattggcatatgcttctccctcgtcacgaagtacatcagcttcagctgtgataatcaatgcagatggaagcccttgaagctgctcagcagttgcacgcagaggtgatgctgtaatttcagcacgctcgttcgaattggttgtgtactgatcccaaaaccacatcatcgcgtccttgcgtaaaaagtatcctgcagcaaactggtgataggattccgtatcgaaagaagcgtctgttaccggatagaaaagtaattgttgccggatattcaagtcacctcgtgctttggccattagcgtgacagcagcagccatattgcctccaacactatcacctgcaattgttagactctcgggaatcatgccgttctcacggccattttcagatgcccacttcactactgcatagatttcttcaatggctgtcggatattttgcttctggagataaggtgtaatttggaaagacaatagcagcttgtgctccgactgctagctcacggatgagccgatcatgtgtatgctcattaccaaatacccagccggccccatgaatgtacacgatgacaggaaggtgcgcaggcgcattctgcgggcgcattattcttactgatacctgtccgctcggtcctcctgaaatcataacatcttcaatatcaactggcagtttatcaattgggtcagattgaacctcatctacagcttctcgtcctttctcaggtccaaggtcgaatagatagggcgggttcgcggttgcttctgcaaattcttgagctgctttttctaattgtactttctttaacatcaatctcactccttatttgaaggctggtcacctatatgttttaatcaaatttttttattctattgcctattgatcttgacatctttcgttttacattgctgttgtaatgatttgtacatcaatatttccgcgagtagctttagaatatggacatacttgatgagctgcatgtgttaattcttccgcttgctcttgagataccccttgaatttccacctccagaacaactccgattttataaccattatcactttcatcttttaataaacttactttaccggtaacagctgattcgatttttaatcgttgtctctgggctgctaaatgaagagcactgtcataacaagctgaatagcctgccgcaaataattgttctggatttgtagccgcggatacttgatttggttttggcatagctaaatccaaatcaataataagatcattagatgttacatgaccttctcttccgccttttgttgtagcttctgctgtaaaatatactgtcatcatcaaacactcctataaattaaatttaacacaattgaattttaatcaatctaatcagtgttgtcaattaaattttttgaaattaaattgtcctcaattgaaattcgcaattaaaatcctctaaatgaatgattagactaaaataaagaacagttttcggcagtttaaagttagtgtacataataaccatattgagaaggtggctcaataaatctatgagtcggtctaaacaatatagtagaagtatctatatcggtcataataagaatgcacctcaaacacattttggttataaataaagtttccatgtatataagttatggttaattaaattgtcagtcattcaatttcccttaatgtaattcttatgctattatgtgtagtaatgaatataaatattgtgagggatttaacatgaagaatgataaattactgttaagtaatcatctatgttttgcgatttatgcagcttcccgtgaaatgataaagttataccatcctctcttaaaagaattaggaattacgtatccacagtatttggttcttcttgttttatgggagaaggaaaaaatatctgttaaaggtttaggcgaagaattatatctggactccggaacattaactccagttttaaaacgacttgaggagcgaggtcttattataagagagcgttcaaaagaggatgaacgaagtgtaattattacgttaacaactgaagggaatgagtttaaagaaaaagtcacaatgatacctaatgcagtatttgataaaaccggttgtaatgaagaagaaattaaaagttataacaaggaaattcgtaatttacttcacatgctgacaactgagcaatagttttatgaatatagatggcgggccaagcgggtgaataacctgcggaggttcaagtcctctcggccgatccctatgataccaagggttttgacaccttttgtattttttgtttatagacttactatagtaggtcgtatgatttgtcagccaccttcatccttctgctgactgcgggtggcggtagtaaataggataatgcaattaatgaagtgatgaagcaggagaagaaagtcagaaaagaaatgcgagcagattcagatgagtacaaaagagataacgccataatttctgtatatgatgacggcaagtatattcagcgttttatcagccagaagaaagttctcgcaagcttactgcttaaaaagccattttttcaatcaaaaaatcaatatcaattcggggctggattcaatatgatccagtccctttttgttttattgatttttcttatccccagtctgataaaagattttctgtgaatcatttaacaattatcggccgttttttctttttcgataatatcctttaccacatcctcaattgttatatgtcgaagagctttttccaaggcagattgggcgatttcaaatattggaccaattgtactttgtatgttccggcctacaggacattgaggattgggattttcatgtatactaaacaattctttatcttgaacaacattaactgctctataaacatcaagtaaggtgatttcagttaaatctttcgctaattcagctcctgcaatacctggccgtacatttactaaacctgcttttttcagcatccccataatttttcttattaaggcgggatttgtatttacacttccagctaaaaattcagaagtgctgattccgtcttcatttatttcaataagagccaatatatgaattcctacagcaaaacggctgctaatagacatgatttcttcaccatcctaattactttacactctttatagtacacttgtaactgaatgtattacaagtttatttcactctaatatgctcaattaacaagatgataaaagtattgacaaataaataaggtgtaactaaaattattacatgtaatcaatttgcttacatttaaaattttgaatgattagggggactttaaattgaaaattggaatcattggtgcaaccggaaaagctggaagtcttatcttgaaagaagcggtaagcaggggacatgaagtaactgcaattgtaagagatgctgcaaaacttaaagaggaaaaggtttcaatcattgaaaaaaatataattgatctgacatcggatgatctaaaaaagttagatgtaatagttaatgccttcggagctccattaggagaagaacaggcacatgtagatgctggccgggcattaattagggcattaaaaggaataggtacaagagcagtaattgtaggcggagcagggagtctttatgtagacgaaaataaagctgtcagtgtaatggatacacctgatttcccggagatttttattccaacagctaaagggcaaggtcgtaacttgcaagagctaaaggaaacttctgatatgaactggacatttatcagtccttcagcggtatttgacccagacgggaaaagaactgggttttatcagtcaggaaaagatcatcttcttgtgaactcgaaaggcgaaagttatatcagctatgcagactatgcaattgcagtattggatgaaatagaaaatccaaaacatataaatgaacgctttacagttgtgggagaagctgaataagttactgagtagaaacaaagggcgccattagcgtcatcgctaatggtatcttcctcctaagaatgtacggagacattgaaaactttgcaatcagagtagctgattatttttatgaaaaaggggatttatcacgttccaatgaatattatcgagctgatgacagagtaggagcttagtgagttggatcaaaaaataaatagctctgactaaaacctttgcgggttagttagagcttttgtaaacccactcgttttcgtgagtgggcttttggaaaatacacctatcaacatgatatttattattaagtacggtaaggggtccgtcaaaacttctaatttccaaatgaaggttctcacaaaaaaacctgccgcacgtttaacaaataaaaccctgaatgaaacatgatattaatttgcagttatttccgtttcgtgctatgataaaggagaattatttttgttcgtgtaaaggatagtatgaatatcgacttttcgtcttgatgatactttgggcaaggatagtaatacaatgtgtaatacactaggaggcaacaaaaatggaacaaggtacagttaaatggtttaatgcagaaaaaggttttggatttatcgaacgtgaaaatggagacgatgtattcgtacacttttctgcaatccaaagtgacggattcaaatctttagacgaaggtcaaaaagtaacgtttgacgttgagcaaggtgctcgtggagctcaagctgctaacgttcaaaaaactgcttaatcttcaatcgtttatacaaacaggctctttatatagggcctgtttttttatgttctctgtatcatactgaataaaaaaccctactcaacgttcgagtagggacagatgctacaaggtaagaaaaaggtttaaaacctcaaaggattgtttacagtataacataccggattgacgatatgtggaatatataaatgatttgtttttatgttctcaaggtaacggtatgttattctttgttacaattcgcatatcttttttatgaaataagataaacaactgctattcactgtcgcaagagatgtaagaaattctgaaagataaaggggagagtggttgttttttcttccggaaataatcacttagacctaaaacaatgaaagccctgcctctcttccatccttacggctccttgtccgtgccagggtgaatcaggattacaaaaatcaagtgactatttcatcgagaattcaagtgttcgttgaagaaaaaaatataacagattagattgaggagtaataaaagcggttaatgtttaaaaagtaagttgaagaagttgaacgtctgatcgtaatactctgaaaaacttatctgtcattaaccttaacagaaactttttatttgtttttcagtgattcctttaatgacttccagttcactaatcaaaaattcatatgcattatccaacatttttttttcgcttgaattaagtgctttttctttcttcatacgcattaaatcacgtacaacttcagcgccttcttgtatttcacccgtttttattttgttcgtgtttattatatacctttgcttccacggcagtaacctatctgattctccatgctgaaaaatgtgtataatgtgttttaatgcacgtatatcagtaactggccgtatatttgaactcaatattttacgcgttggaatcataattgtcatattactgattgacattcttatgacataatactgttgtttttcctctaagaattctttttcttctatggcttcaattatacctgctccgtgcattggataaacaatgttatcgccaatttgaaacatataatccacctccatatatgggaacttaacttaaggttaccatatatagagtgagatatcaaatttttaataataacatgattgtttatttgtgtcaataacttttttcaaaaaaacaacatcaaaacaagagggaacctgtgagattcctaaaaaagggaagatcaattggtcggggtatattttggaatctcgactaattaacagagatcagtttttcgttgaaaaggagttattaaatatccattaggagttcatggcttgacatcaatgacagcaattgaatccttggtttgtttacttttttactttttcgatgtcttcttctcctcaaggataccaatcatgcaattaagagcacgttgaattaaatatggggtcttcttgtgattaatcttttgggtttaacgtaaaacaggggatactaatattaactctttaaaatcattctcatgccgtcttgaaaattgacagtatacctgtaagggtataatattgattcacaaacattatttagttaataatgtagtgtgataaagcgtagtatgaaatgatagtggataacatgcaaatatataaatttcaaagaaggagttcaacgcatggaatatgatcaaaagattaaaaatcgcttacgccggatagaaggacagataaaaggtgtattgaccatgatggaacaaggaaaagattgcagagaggttgtgacccaattagctgcttcacgtaatgcgatcgatcgagcaatgggtttgattgtgagcacaaaccttgaacattgtgttcgtgaaagtttagaaaagggagaagacacacaacacttagtaaaagaagcggtcgacttattggtaaagagccgataaaaaaattcatcaacctatcatctttaaggttgacgaatttttatattcattataatatacccctaccggtatttaatatgttgaattgaataataggagatctttcgaaaaaatttttaatttcaatatacccccaggggtaatagtgattggtcaggagaataaacatgacaaaacaaacaaaacgcacaacaattgttttatttagcggggaatatgataaagcaatggcagcctatattattgcaaatggtgctgctgcctacgatcatgaagtgacgatcttccatactttttggggattaaacgctttacgtaaagaagagctgattccagtgaaaaaaggatttcttgaaaaaatgtttggaaagatgatgcctcgcggtgccgataagatgggtttatctaaaatgaactttgcaggtatgggccctaaaatgattaaaaatgtgatgaaaaagcataatgcacttacgttgcctcagttgattgagatggctcaagaacaaggtgtaaagctcgtagcttgtacaatgacaatggatcttcttggtttacaggaaaaagaactattagatgatatcgactatgctggtgtagctgcttatttggcagatgcggaagaaggcaatgtcaacttatttatctaatgtgatccattgcaaattgaataagtgaaggggggatataacactatgaatagcggagtaatgttcaatactttactcattttatttttactttggatcgtatttcgacgttttttcccattgcatggtgttaaacaaataacaactgctgatttaaaatcggaggcggaaaacaaagacaaacagtttatagatgtgtgaacttcttatgagttctgtacaaggcatattaaaggatttaaaaaaattcctttgtctatcttgcctcgtcaaactcatcaactttcgaaagacaaagacgtctttgtgatctgccaaagcggaatgagaagtgtaaaggcaagtaaaatattgaagaaacacgggtttaaaaatatcacaaatataaaaggcggtatgaatacatggtattaacatccagggaataactttttgcatatttttatacccccgcccctatataagaaaaggaggaaaaaaaccgtgaaagcaaatattgtattagacgctaaaggcttgtcatgcccaatgcctatcgtaaaaacaaagaagaaaataaaagaattaaaagctggtgacatattagaaattcaagcaacagataaaggatcagcggcagatctgcaagcatgggcaaaaagctcaggccatgaatatttaggtactgaaacagagggagaagtccttcgtcactttcttcgaaaaggaggagagcattcatcagaaaatgcatcttccattcctgagatttcattagaagctttcacacagaaagtggatcgtgatgagtctcttcacattttagatgtacgagagatagaggagtatgaagaagcccatatccccggagcggtgcatatccctcttggcgaagtggaaaagcgctttaacgaattaaacaaaaatgatgaaatttatattatttgccattcaggaagaagaagtgaaatggcagctcacaccatgaaaaaacaaggttttaaaaaagttattaatgttattcccggtatgcgggactggacaggtaaaacagaaaaaggaggtatgtaaacatgaccgtgcaagcacttaccgcaaaagaagtcacacaaaaaatctttcacaaagaacctttatttattttggatgtacgtaatgaaaatgactttagcgattggaagattgaaggacatgattttgaccatttaaatgtaccgtatttcgatcttttagatggcgtagaagatatcttggagaaaattccttctgataaagatgtgctggtcgtttgtgcaaaagaaggttcatctgtcatggtatccgaaatgctttctgaagcaggtcattctgtatcctatcttaagggcggaatgaaagcatggagcgaacatttagagccggtaaaagtcggggatttaaaagatggcggtgagatgtatcagtttgttcgaatcggtaaaggctgcctatcatacatggtcatttccaatggtgaagcggcgattattgatgcgacgcgtatggtagatttctttatggattttgcgaaggagaagagtgcgacgattactcacgtatttgatacacatcttcacgcggaccatatttcaggcggcagagtcattgctgaaaaaacaaaagcagcctactggttaccgcctaaagatgctgaagaagcggtattcgattatcagccgttggaagaaggaaacgacatgaccatcggaaatacaaagattaaaattcaaccgatttattctccggggcacacgattggttccacttctttcattgtcgatgatcagtatcttctttcaggtgatatcttgtttattgattcaattggcagaccagacttagccggtatggcagaagattgggcaggagatttaagaacaacgctttatagccgttacaacgcgttgtcacaggatttaattgtattaccggcacactttatgatcattgacgagctaaataaggatggaagtgttggtaaaaaactaagtacattatttagcgagaaccatggtttgaacattgcggatgaaacagaatttagacacttagtaacagatcatttgcctccgcagccaaatgcataccaagagattcgagaaacaaacatggggataatcagcccagatgaagaaaaacagcgtgaaatggagattggtccaaaccgctgtgcaatacggtaactcaagtttctattaaaaagaggagagatgaacatgaaatcagataaagtattagacgcaaaaggcctggcatgcccaatgccaatcgtcagaacaaagaaagcgatgaatgaactggaatcaggtcaaatattagaagtgcatgcaacagataagggagctaaaaatgatcttgcagcttggtctaaatcaggcgggcatgatcttttagagcaaactgatgaaggcgatgtattaaaattctggattaaaaaaggctaatgaatgtgaaagggtatcgaatacaaagatgccctttttctttgaaaggaggaacccaaatggatattgcttttatcacaactcttttcattatagggtttattggtgcctttatttccggaatgatgggtattggcggatcagttattaattatccaatgctattatacattccttctttagtgggagtgatgtcattaactgcccatgaagtttcagggataggggctattcaagttttctttgcgacacttgggggtgtttgggcttatcgtaaaagtggttttttaaataaagcattaattatgtacatgggaagcagcatccttttagggagtgtattggggagttacttttctcattatatatctgaaaaaggaattaactttatatacggaattctggctatactagcagttattttaatgtttatacctaaaaaaggacaagaacatagcgaagacgaagaagtgatatttaataaatggttggcttcgtccctagcgtttctcattggcggcgtatcaggtattttaggagctggcggcgcctttatcctggttcccattatgttatcgattttaaatatccctgttagaatcacagtcgcttcatctcttgcgattacatttctttcatctattggcgcaacagttggaaaagtaatcacgggccaggttctttttacaccggctctggttcttatgattgccactttgattgcttctcctattggcgcatcagttgggcaaaaagcaaatacaaaattcctgcaatggattttagcgttattaataagtgcgacagctattaaaatttggttaaagctcctttgatatgagtcagcgggtaaaatgaaagattaaaagattcatcacccgttggtttcttattaattctttttgataatggtgacttgggcaagtcttgactatagtaccgtgaaaaacatttgacttagttgcgtccagtatttttttgcatttaggacagcgttttggaacactataaacctgtacgttttaaaacgaagatggtgattttaacaaacatggcacccaagacatgtcatgtaactttctggtgatgaaaaaaacgactccatttttactccacaatatgaataaatctttgtaaaataacatgatcaatataaacacacactaatatataaaggttttgtaatagaaaacacaattattgatggcccagcgggtgaataacccatggaggttcaagtcctctcagccgcattaaatgataccaagggttctgacacttttggtatttttttgtttgcggctgcgccgttacttaaagcaagtcgtctggtttccagctatcttttttaaagccctttttcaattaatgaaatgataaaataggagaagaaagccagaaaagaaatgagagcagattcagatgagaaacacaagaacaactcatcgtgatcgtattcgtacacatttttacagaggaggacaattatgattggaatactggcaggaatggggccaaaatctactgggccatttgtagataaagtcgtagatgagtgccaaaaaatatatggagcaatacatgacatggattttccacatatgatgatttattcctgtccgacacctttctacatgaataaacctctcaatcatacggacatggaaaatgcaattattaagggtgctgtaaagcttgaaaaaacgggtgttgattttattgccatcccatgtaataccgcacatctctattttaatcaaataaaaaaatcgatttcagtccctttactgaacatgattgatgaaaccataaaaaaaatacctaaaggctcaaaaaaagcagctcttttagccaccgttcctacggttcaatccggaatatttcaagaagcgttaaacagagaaggttatgattttttacatcaagatagttggcaaatctatgtcgatcaaataatagaaaaaattaaacaaggtcaaatcgatgaggctggtacattatatgatgaattacaccatgacttagcagaaaaggctgatacggttatcattgcatgtacggatttaaatatggtcacggaccaaaaaagaagcagacttactattgttgattcatcagcctgtctcgctcaagccattgtaaataagtatgtatcattaacaaaataagtcatctgatttatcagcaaattcagggcgctttttttcctttaaagcgcccggcttcggcagatgcatgatcctcaattacttctttgaatgtaacttccccgcgttattgttcttttaacattgaatactttcgatacgttttatagaaactgcagccaaatagaacagccataagggcgggaagcgacctcaacagggcaaatggagtttcaaataaaaatgctttccaaaacattgcgctttccatactccacagaccttcagttaaatataaacccgaatccttgtaaatcaaataagaataaaacaagcacagtaaaccaaaacaagatgaaaaccccattagtcttttataataattactctttgattggcgatccgaaaagatttcattttgatcatcattttctttttgccaataccgagttccgctaagccatgggctgtttatataaacccagccgaagtcttcatagatctctttgtactctttaaattttttctttgataaataatcttgataatccagtctcatcacatattttttgtcggttttttcgaaagtgtatattcctaatccgctgatatttgtacagcgatagcctttttgtagttgctcgttcagccattgctcctctttttcaatatcaaaaaacatcttaaatttcttcattcgattcacttccttcgtgcagggataaaatatgcagtaacctgttttgttccatcttcaaaatggcgcttccttccgcagttatcttatagacttttctccggcctgattctccaacaggctcaatccagccatgcttattcaaattttcaatcgcgccgtataatgtgccggctgctaaaataacagttccgttactcatcttttcgatcttctgcatggcggcatagccatgaagcggctcacggagagctaataaaatataatgcatggtttcagacagcggtaataatttatgtttcatatcctcatcctctattcagttcgactatatagttaaacttaatacagtacaactgaatagtcaatggccttttcaaaatttgtaaaaggaacttgaaaatcaaatctaaaaagtcgctttctttacgtaatgggaagcgacttctggggcagttctattcaataactggcccgattgaacgcattaaaaataccaagggtttgagtcccttggtattttttgttcattgtatgatgatgtaaacttcttgcttatttagcgctgtcgttccagtttttctctataaatgtattcgcaggctgtaagttggttttgtttgcaatttcaatgacagcgggaaccacggaagggtctgttttggagaagttaggaatccgcggatctaaccggaaatagcgatctcccagcagattcgcgctgaccatggattcatagtagccatttccgccggagatcatctgaagaaatggcagtaaaggttcattaggcgacctgtccaaaaggactccccaatttggaggaaggttcttcagattttcgggacgtatgttatccgcacttaccattccccatcccctcgtatctcttcttaaccgagtcggggcttcacctgtaccgatggatagcgccgcaatttgatccaatggcacgttggctttaccaaccgcaaacgcgatactggccgtactggggttcgttgccactacatatccgtccacgtagttttgataggcgcgctgtgtcgcgggagcaccgctgctccgcagtatgacatcactcactttctcatttaaatagggagagccgggaaagttgtgaaataatacgggcgtccaacgatccagtgccggggagtataatttgaatgaagggacaacaattcgttttcttacatctttaagacgaaggcctggcgggaaaaagtttcgtaccgctttaataaaaccggaatagggtaattgctgattaaaaacaggtccgcccggccgggaagtgctgaatgcgggcaggatttcatcctcaaaatactgaagtgtttccttcggagatcttccgcttgctaatgccagggcagtaaatgaaccgattgaatttcccgcaaatacatgggttcggcttattaatgccggattttcttcagccagtctgttcaatagttgtaaacttaaagcacctaaggtaccgcccccgtcaaaggtcatgatccgatattttgccaaagctgatttctcctttctgatgaaaactatcattcagtatatgttcagccagagtctattgtatggatgaatgaatatctccttatcttaaaaatagtttgattatcaatccggcgagtcgggaaaggatatgttttttatttgaagaggttttttccgggaagaaggagaattattatttaaaaataaaagggggaaaatacttgaatacaattgaccttattgttttacattttgaagaggtaagacggcgaagcatcaagttatggacagctgtacctgaggaaaaaatggactggcgcccggattccgaagccatgtcgtgcaaggaaatgataagacatgtattagaagcggaatttctttatcatcaaattttaatgaaaaatatgagtgagttttcagaggaaactattaatccttatgaatcaaaaacgtttaccacagtaagcgaagaattagaatttgcaaaaccgtatcgggccgcgtttttgacattcatcaaatcgttaagcgaaacagatttaacaaatataaagattgacaggtctgatgttggatatattcgcgaactgggagacatgttattaagaatcgcttaccatgagtctgtacatacgggtcagcttttagactacctcagaactgctgaggttgacaggcctttaatttgggactagttaaatgattgagttttacacgggaaggggaaataacggaagccttaacttcacccaaagttaaggctttttataaattgttaaaacaaacatgttgccgttgttttaatgatctgttccccaaaccgctttccgataattttccggatcagtatcaccttctgtattaatgattaacacattagatgactgatctaattctaatttcttctttatctgttccattgaagtatttctacttaactcatgcagcaaacctaatggtacggaacctgactcaccagaaataatctttggatccgaatcaataggattacccaatattctcatccccaatgcgcttatcttgtcattacaggaaaagaaataatcactgcttgttctcaaaatgttccaaccgaatgggttgggttcgccgcaggcaagcccagccatcattgtagaaagatcaccgtatactcggacaggtgatccagaggcgctttgggctgactggtacagacaatttgcgctttcgggttcaactatggagattatgggcttattcccgctttttacatttaatagggaagctgccattgaagcagcgaaagatcccactccagcctgaaggataacatgactgattgtattgaagaaatcttcattttgtttgtatatttctgccataattgttgtatatccttgcatgatagagagaggaatttgctggtatccttcccaagccgtatcctgaactaaaatccaatgatgtttctcagataaatctgccgccatttgaacagtgtcatcataatttaaatctgtaatgtacgcatcagcacctaaatgtttaatggcttccaatctcgcgggagaagaacctttcggcatatatacctttgctctctgtccaaaaagagaagccgcccatgccagtccctttccgtgattaccgtcggtagctgtagcaaatgtagcagaaggagcgctttttacaaattcaaccaattcgttaaaatgaatggaattaaggtcgattctaaatttttcacaatagtaagaagcaatcgcatatgaagcacccaagcttttaaaagcattaaggctaaaccgtttagattcatctttgacataaagactgtttatgccgagatattgtgcgagacctcttaacgagtgaagcggtgttgcttgatagccgggaatgccggaatgaaaatgaagcgctttttttgtttcctctgcagagaaataggaagattcctgaggtaacgtatcagatctgaaatgattcgaaacccaatcaatattcgcaaacaaatttcttcacccttccaatatgtgatatatcacattatacatggatcggaatgtaaagcaactcttctttttcgcaaacgatatactgaaatgtggtatattacatgtaaaatgatgttttaaagaggtggaaacgtgacaatgaaccaacagcaccaattaaaacgaacatttatgaaagttgaagcttatcagtttctgagagagtggattataacaggtaagcttgagccgggagaaagactgagaaatcaagatctatctgagacactcggaatcagccgcacgccggtccgggaggcgctgcttcagcttgaaaatgaaggtcttgtcataacgaaagccaatcggtggacagtggtagcacctattgacctggaaaatgcgaaagaggtttactcggtcgtttggtctctcgagtgtctcgcttttgaacaggcactttcaagatttacgcaagatcatataaacgagatggaaaaattaaataagcaaatgaatgcaatcatggagatggatgataaggtaaaagcgctggaattggataatgcctttcatcaaaagatcattgaagtctcaaataatactgaactgcagaaattactgcaaggacaaaaaacgaaaatacagagaattgaaattcggtatttcagtcaaaatcacgcaatgaatgcatcctgcagtgaacactatcaaatattagacgcaatgaggaataaagatcttaaacaaggactgaatgccataaggagtaattgggaaaacagtctgactcgaatcattttaaacagccaattaaaagcctgacaactcgtcaggtttttttatgaatttttcatttgactaatatgagatatgtgatatattactcttaactgaaagcaattcagttttttcgtgaagaatattttgaatcttatatcaataaggagaaggtgattattatgttaaaagcagttttcacagaaaaagcaccaaaagcgatcggaccttattctcaaggcattaaagtacaagattttttatttttatcaggacagcttcctgttaatccaaacacggatgaagttccggctgatattagggaacaaacgattcaagttttaaaaaatattgaatccattctgaaatcagaggatttaaaaattgaaaatatagtgaaaacgactatttttcttaaaaatttaggtgattttcaagctgttaacgaggaatatggtaaatatcttggagaccatcgtcctgcgagatccacaattgaagtaagccggttgcctaaagatgtacagattgaaattgaagtcatcgcgtattccggataaatatatacgagtgaaaagctgcccgacttcatggtaattcgtgatattccagagcatgacattcttttttcgggaggataaatatgtctatagaacaggatgtggatgtgcggtgccggagttcttcatcgaataatgcctcttatgaagatccggctaaatggtgcaggcaaaatacaatttgggtcttaggcctgtttggcacagcaataggcgcgggcgtgctttttttgccaattaatgcgggaatagggggcattctgcctctgatgatcatcactgttctggcttttccgattacgtacttttctcacagagctttggccagatttgttttatcagcaggttctgcaacagacgggattttagcggtgacaggagaatactttggagcgaaagcaagaagagtattcactgtcatttattttcttgcgatttacagcatcctgttaatgtattcagttgccattacaaatacagctcaaagctttattgtgaatcaaatgaacatgtcagagccgccaaggggtttaactgccggatttctgatagcaggattactgtttatcgtgcgttttggtcaggatgcggtcatgaagactatgagtttgttagtttatccatttataggttcgttatgtttgatggggatctatctgatacctaaatggaatacagccattttggatgtcacacacttatcattatccggatcaggacaagggatgttcatgacggtatggatgacattccctgtcctggtgctttcatttaatcattattcaatgatttcaccattcgttgtagctcaaaggcagtgttatggagacaaatttgctgatgataaatgtgctcaaatacaaaaatacagttatatattgatgatacttactgttttattttttgtatacagctgtgtattcagtttgtcgccggcagatcttgctatggcaaagaaacaaaacatctcaattctcacttatctcgccaaccattttcattcagtgtttattgcttgtctttccccgattatcgcatttgtcgcaattacgaaatcctttttaggacattatataggagcctacgaggccatgcgggatatcattgttgaggtttttccatcaagaaataataagaaaaaaacagattttatcattctgttttttatgtttgtcacttgctggctaatagcttatatcaacccaagtattctaggcatcattgaaagcatcagcggaccgataggggctgttattctattgctgctccctatgtatgccattcgtaagctgccagtattaaaaatgtatcgaaataaaatcagtaatgtttttgttacgattattggtgtcatcactgtttcggcaattatttttgctttattttaattattttttgtaaacgctttctatttaatgtttatattggagtggtctttatgaatgatatcacaatgaaagatcaattaataaaatggagacatgacctccatatgatacctgaaacagcttttgaagaacacatgacctcagcgtatattgctgaagaattaaaaaaaatgggagtaagcgtttgtttgggtctgggcggaacaggtatagtcgccaccttaaaagcgggagaaggatcaaaggttataggaatcagagcggaactggacgcattacacttcactgaagcagcagatcattcgtatgtgtctaaaaataaagggaaaatgcatgcctgcggtcatgacggacatatggcaatccttcttgggacagctaaaatattgagtgaaagacaacattttaacggcaccgtgtgttttatttttcaaccggcggaagaaccgggcaagggtgcgagggctatgattgaggatggactttttgaacaatttccgctcgatgaaatttacggattgcataatatgcctggattgccggcgggtacttttgcaacccgccccgggggaattatggccggtgaagataactttgtcatccggattaaaggaaaaggcgctcatgcagcccgccctcatatgagtattgatccattggtcatagcgtcgcaaattattctcgccttacagactattgtgtccagaaatttagatccaagcgttcctgccgttatatcctgtacggaaatcgtaacagacggggtgaggaatgcgattccgacttatgtggaaatcaaaggtgatacgcggagttattctcctgacatccgacgttttctcgaagaaaaaatgaggactatcagtaccgggatttgtgagatgcatggtgcggagtgtcagtttgagtatacacatgaatttgctccaacgacgaattgggaagaatatgtcgggtttactgttgaagctgctgccaaaacagccggaaaagagaatgtcacttctaacataaatcagatgatgatttcagaagatttctcggcttttttagagaaggttcccggtgtatttgtttttcttggcaatggggatgagcatgatcaaaagggccatattccattacacagcccgtcatatgattttaatgatgacattcttttaaccggtgcagcgtattttgcggaattagttaaaattcgcttatcctaaaacacatgaaacaaagaaaaacagcaattactgaatcagtcagtgctgtctttctttgtttttttgttttttataagccagcggcgtcatcttcatggcatgtctgaacctgctgatgaaataacttgtgctgttaaaaccaacttgataagaaatgtctgtcacactcgcatctctttgctgcaataaatataagcttttttgaattctgtaatctataacgtagtgtaacggagaacattttaaaaagcgcttgaaatagcggcagcactcagaacggcttagctgcccggctttcgcaatatcctccaatgtgattttttcagcataatgctgatggatccagctcagcatattcttcatcctttggttcttcaaccattctgtttcgatacattcaaggtggaagcaattggcgattaagtgtttccaaacagacgtaagtttcatcgtgatatctatttcataaaagggtgatttttgctcgatgcatttgtggatctctaatacagcattcagaatatttttttctaaagggtcgtctgcgtggatatataagtaagggacattcgttgcgtgaatcaaaggttttacataggtcgtgtagagttcctgtgataaaacgaaatgcggggagacatttaaacagatataaagacaatctgaactgccatgctcctttgtcatatgcaggcagccgctgttaataaacagcccgtcgccttgacggacaaccacccattcctcatttacttggaacagcgcttctccttttattataagcacgaattgaatttcatcatgccaatgaaggggaatatatccgtgcaaatggttcttaatggttttttcatagcaagcaaccggcataacaattgtatggtgtttcgtcaaatcttgcagactgtcatccatcagaaagttttgcgtttgcatgttaaacacctcaatatacttatatttttaaatccaatattggtattaagatgatgaattctcatatatcataacattattgttatatctatgaagcgattgactcagtacagggaggaatgcaaaatggcatctgaacatgtgaacctttacattaattctgaacgtttactcagccgtcttaaggagcttggtgaaatcggacgtgaccgcaatgacagactcacaaggttagctgcttccgatgaagataaggcgggacgggacttattggtaacatggatggaagaagcaggcttagaggttatgattgataaaatcggaaatattttcggggtatggtacggttctgatcagaataatgatgcgcccattatgatcggctctcatatcgacacggtcatcaacgcgggtatttacgatggatgttacggggttatttcgggacttgaagtcataaacgctttaaaggagtccggcttcaaaccggagcgtccgattgtcatggcggcttttaccaatgaggaaggtgtgcgatatactccagatatgatgggatcactcgtattcgccggaggactttctttagaaaaggcgcttcagacccgcggtacggatgggacgaaactgggtgaagaacttaaacgtataggatatgagggaacagaaaagcccggctttttaacaccgcacgcctttattgagctccatgttgagcaggggccgattttagacaaaacaggcattccggtcggtgccgttgagaatttgcaagggatttcctggaagcgtataacggttcaaggcgtttcaaatcatgccgggacaactccgactgatatgcgtcaggatgccgggcatgcagccgcacaaatcataacgtatttgcgcaaacgtgccaatatgtctaacggccaaactgtcgccacggtcggaacaatcagttttgagccaaatgctatcaatgtcattccatcattggcagcacttacagttgatttgcgagatccggacgaaaagagacttcaagaagaagaatcagcactggacgattacctgaaagatttggaagaggctgaaaacgtatctatcacatctgaacaattagtccgtttcaatcccgttgtatttgataaaaacattgttgcattaattgagcgggctgccaataaacgcggactggagtcaaaacggatgacatccggtgccgggcacgatgcacaaatgatggcccgcatctgtccgacggctatgattttcgttcccagtatagaggggatcagccataatcctgaagaatacacgaaagatcatgacttggctgcaggtgtcaatgtattattagatgtcgttagtgatctttcttctaactaaggaaacgggaacatcaaggaatacaaatcgagataaagagtgaagatagagagtgtcgtacagaaaagcccttctcatcattgatatctctgatgaaagttcaatttttcccggcgtatcaatcatgccaaaggtttaaccgcctttggctttttttatgtcaacttttgcgtctgttaaaattgttttataaacggtgtgatcatataattgaatgaaaaaggatgcatatcatgccgatcaattcttttgaaaactatccgatgagctggaagccggcgattgataaaacggaaaaacccatttataaagcgattgcagagaaattagaacaggatatattacaagaagttttattacccggaaccaaactgcctcctcagagagaactggctgattttttggatttaaatgtaagcaccatttcaaaggcttttaaagtctgcgagttaaagggtctgctgagtgcctctgtcgggagcgggacatttgttgcttatgatgcgttatcgaatgcgtatctgctggaggatacaaagccgaagcatctgattgaaatgggggcgacgcttccggatcaggcttcttatgagccgctgctgctccagctgaaaagtatgctgcaagaggaagattatgaaaagtggtttggctatggccggacgggtgaaagtctttggcataaagatgcggctgttaagctgattcgaagaggcggatttgaaacgtccgttgatcacattttatttgcaaacggcgggcaaaatgcgattgccgcggcattggcgagtctttgtaaaccgggtgaccgcattggagttgatcaccatacatacccaggcttgaaaacggccgcttcaatgctgagtgtgcaaattgtgccgatcaaatcagagaacaatgaaatgagccctgtctcatttgagtacgcgtgtaaaaatgaaaatattaaaggcatctacctcatcccggattatcataatccgacagcgtcctttatgtctgttgagaatcgaaaaatgatcgcgaaaatcgcaaaaaaatataaccgattcattattgaagatgcctcgtaccatcttcttggcaagaatccgcttccggcaatcgcatcatttgcaccggaacaggtcattcacattgccggtttatcaaaatcactggcaccagggttaaggatggcgtatgtcgccgtcccgagtcaatataaggagccgatttcaaaggcgctttacaatttaaatataaccgtttccccgctgttagcagaactcactgcacgcacaatcgtatcgaatcaatttgaaatcttaattgacagtcatcgtgaacagactattcgcagaaacaaaatgatcgatcaatatttaaacggctatacgtgtgcaggtgctgagacgggaatctttcgatggttgctgttacccggaaatatgacaggtgctgcatttgaaaaatcagccgcacagcatggagtgcaagtatacgcggctgaacgttttgtcgtcgggaacagttgtccggaaagggctgtaagggtgtctgtctgtgcaccgaaaacgcttggggagcttgagcagggactgctgattcttaaacgcctgctggatgagcttatctaatattgtccgccatacaattactatattgtatggtttttttgtgcgtgttatgataatccaaatctgttggaggttatagaaaggcaggtcggattatgcttcacaaagacagtgcaaaagggtcagatactcaatcggcattattggagcaattcataggttcttctgataaacaaaaaagattatataagcgtactttgtttgtcgtcagtctttcacaaattttcggcggcgcagggttggcggccggagtgactgtcggtgcgcttattgcacagcaaatgcttggtacagatgcgtttgccggtgtgccctctgctttatttaccttaggatcagcaggcgccgcgttatttgtggggaggctttctcagcgttacggccgccggacaggtctttcagccggatttatgattggcggactgggagcgataggagtcatcattgcggctattttaaatagtgtgtttctgctgtttgcttctttgattatttatggtgcgggaacagcgacaaatctgcaggcccgttatgcgggtacggacttggcaaatcataaacagcgggcgactgctgtcagtatgactatggtttttaccacattcggtgccgttgcaggcccgaatttagtgaatgtaatggggaacttcgctcgctccattggtgttccgtcactggcgggtccattcattttagcggcggcagcatatatgttggcaggtgttactcttttcatcatgctacgtcctgaccctttagtcatagcaagaacaatagaaattgccggccaaacacctgatgatagaggacaagtgaccgccgacgaacacacagagaacaaaaaaggtattattgcgggtgcggcggttatgattcttactcaaattgtaatgactgctattatgacaatgacaccggtccatatgagacatcacggccatggcttaggagcggtaggtcttgttatcggttttcatataggcgccatgtatctcccttctttggtgacaggtgtgcttgcggataaattaggccgtactgtaatggctgtatcttccggaatgacgctgcttttggcagggctcatatcagcatttgcaccgggagattctatgattcttatggtcattgctctgtctttgctcgggttaggatggaattttggtttgataagcggaacggcactgattgttgattcaactgaaacgtcaacacgggctaaaacccaaggtactgtggatgttttgattgcgttgtccggagccgccggcggagcattgtccggaatggtcgtagcaggtgccggttacctgacattatcacttggcggagggatattatcgttattattaatcccggtggtgatatggtcgcttggaagtaaggaatagtatcttatgtttaaaagcagtgcgaggctcccgtggttgaaaaacccatgaagcgtaagtcctcccggctgcatctcaatgataccaagggtgtaacggcctttggtattttttatgttctcttttatttttaaagtttactcttatttgctctgctcaatagactgtcgtttttaaaaaaggttctaaaacgatacaaatgatgcgtttgaacggttgtaagtttgatgtattacaaaaaatagctgttatatccctttatattctttatagtaaatatacggaaaataaataagcggttaaaaatatttttagtaaaggagagtcatgtggaagaagttaaagttgtatacgcattgatcagaaatgagttcaatcagatagtaatggcagataatcatgaggggcattggtcacttccgggcggaaaagttgagcttaatgaaaatctaatagaagcagctgtacgtgaggtatatgaagaaacagggctggaagttgaaattgggaatatactagctgttaatgaagcgaaatttataaagagaaatcatcacgccatatattttttcatttgaagcaaaagttacaggagggaaagaagggattaaaaatgctcaagaaatattgaaaatagaatgggttgatattgaacaggcaagtcaacgattgccttattacaccgaagggattaaaaagcttatgaaaggaaatgcgctgtataacaatcagggaacaatatactgataatcccgtactttgattaatggttgtggagggtgaaggggtaaggtactcgttcttcaaggaaaaaacaaaatagtaataatgatttttacttgaacgacacttaagaataatttaaggttaaatattgaaaaaatttgttaatattataatatattgtttggaaatgtaatcttttataaggagttttctaattgcgttggagtaaatggttcaatattttttgcatagcagcattgggatcaatatatggctataaattgtttactaatcaagaagtcagtacggctcgtgtaatcatagctgctgctattatcttgtggaacattgtcggactttttagcaaagaaccagtaaaacaaacacagcaagcaaactaaaagctaaaaaatactttccaatcgttcaataaaaagttggtacagaaggatgctgcagcgtgcagcatcctttttatcatttttacaaaaaaaccaagggtttaaccccttggttttttcgtagtctccctttttacgctgcttaagataatcgtcaaaatcattcaagtttcatgcaggcatccagattctgttgcaatgataaatgaaaattgccctaaaaatgtgccggttcatcaaaataccagtccaagctgcagatctttctttacatagtatgtagagattaaaaaatgagagaaggagtggcgtaatgtattataacgatggtgacgatcaacagtacttccagaagaaaaagccatacaacgaggcctgtgaccttggccatgattttgatatggcggacgacgatgcaagagcggaagcggcaagagaagcagaagcgagagccagagcggaagaagccatagcaagagcggaagaagcaagagccagagcggcagaagcagcaaaagcagcagctgaagcaaaggtagaagcggcaaaattagcagccaaagcaaaagcgaaatgtaaaaaacgtcataagaaagagaaaaaacatgattgcaaacgtaagcacaagaagaaaaaataagagcttttcatcatgtaaaagataagattcaatgtgtattgattttatccgtacaggggtgcaaaaacgataaagaaaaagattcttgtcgggggatcaaacagaaagattgctcagcagaaccacgcatggcagggcaaacataatgttctatggacttccatagtttggtcgggatatcacgccaataaatgtaagtgcctatcatggcaggagagacaagagtttcggcaggttgccgcacttgtcttttttttgttttttctcatcttcgcgtatatgtatctatttttaagtttgcagaacatctgtctaagaatttgtccaattcctacatatactggtatgggaatcaaatgcttattgggagtgaaatagatgggatcagcacagttaacgggacgtgtcatcttcaaaggggaccccggctatacagaggcggttaagaattggaacccttatgttgatgtctgtccgcttgtctttgtttttgcgcaaaattcatacgatgtaagtaatgctattaaatgggctcgtgagaagaatgtgcctttgcgtgtcagaagcggccgccatgctctggataaaaatctttccacggtaagtgatgggattgttattgatgtgagtgacatgaataacgttttcttagatgaaaaaaacgcggtggcaaccgttcaaaccggcattcacgtcggcccgcttgtaaaaggtttagctcgggaaggttttatggccccgttcggagacagtccaaccgtcggaatcggaggaatcacgatgggaggcggatttggagtgctttcacgatcgatcggcctgataagtgataaccttctcgcactgaaaatggtagatgccaaaggcaggatcattcaagcaaatcattcccgcaatgaagatttactgtgggcttccagaggcggcggaggaggcaatttcggatataacacccaatatacgttcaaagttcaccgtgcccctaaaaccgcaaccgtctttaatattatttggccgtgggaacagttagaaacggtattcaaagcatggcaaaaatgggcgccgtttacagacgaacgattaggatgctaccttgagatttacagcaaagtaaatggtttgtgccatgcggaaggattgttcctcgggtcaaaaccggagctgattcaattattaaaacctttattaaatgccggaacgccggcacaaacagtaatcaaaacactatactatccggattgtatagatttcttagatcctgatgaaccgattcccggcaggtctgatcagagtgttaaattctcctcggcgtgggcgctcaatctttggccggaagaacctattgcagtaatgagacaatttttagaaaaagcgactgggacagaaaccaatttcttttttatcaattggggcggtgcgataagcagagttccaagcagtgaaacagccttctattggcgccgtccgttattttatacggaatggacggccagttggaaaaataaatcacaagaagcttcgaatcttgcatcagttgaaagagtgcgtcagctgatgaaaccatatgtaacaggttcttatgtgaatgttccggatcaaaatatcgagaacttcggaaaagcatattacggctcaaactttgcaaggcttcaaagaataaaggcgaaatacgatcccgaaaatgtattccgttttccgcaaagcatcccgccatcgtataaatagtttgatcgttgtgggaaacaaaataaaaaacacaccagaacattcaggtgtgtttttattgttgctataaaagttggttatttacttatattcccagttaggatgccaaacaatttcccacaagtacccgtcggaatcttggaagtgaccggcgtatccgccccaaaaagtatcatgagcgggagcagttatcgtaacgtttgattcatgtgcgatgtctttgcggtcccagagggcaagtttcagtcccgtttgcaagtcgtccaaatctgtaccggctgttccttctgtattctgtaggcagacccaagccatcccgatagaagtgcagcgatttttctaaattatctgcgcctaaagtaattactgtaatccgcggcttcatagcaatgcaacctcccaagctaagctaatgataagaaacattttcattgaaaatattttgacatttcagtaaagaacctatatattcatatatgagcacataatcatatatggttatttttgtgtccatgttagaatgcttcatagcagaaaagaaataataaatacagcgtattagataaggaggagatttttatgggtcacaatcacaatcatgctggcggatccaataagaaggttttattgatctcttttatcatgattacaggttatatgataatagaagcgataggcggatttttaaccaatagtttagcgcttttgtcagatgcaggccatatgctgagtgattcaatctcattaatggttgctctgattgcttttaaattggccgaaaaaaaggcaagtcatcataagacattcggctacaaacgatttgaaattcttgcagctgtgatcaacggtgttgcattaatactgatttccctttatatcatttatgaagcaatcaaacgtttctctcatccgccggagatagcaacaaccggcatgctgacgataagtatcatcgggttagctgtgaatatattggtcgcttggattatgctgaacggcggagatacaaagaataacctgaacattagaggagcttacttacatgtgataagtgacatgctcggatctgtaggtgccatactggctgcgatccttatcatcttcttcgggtggagctgggcagatccagtggccagtgtcattgtggctattcttgtgctgagaagcggttaccatgtgacgaaagactccattcacgtattaatggaaggaactccggaaaatatcgatgtcactgacatcattcatacaattgaagagacagaaggaattcaaagcattcatgatttgcacatatggtctatcacaagcggattgaatgctctttcctgccacgctgttgttaacgatcagctgaccatttctgaaagtgaaagtattttacgcaaaattgaacatgaacttggagatcaaggcattacacatgtaaccattcaaatggaaacggcagcgcataatcacgacaatacgattctttgtcaggcccaaactgagaatccgcgtgaccatcatcatcattaaggaggagatagggactcactttgtctgctgacaattaagataaaaccggaggggggattcatatgtacgacacgatagtaatcggagccggtcaggcaggaatctcagtaggatattatctaaggaagtcgaaacaaaagtttatcattttagataaaagtcatgaagtgggggaaagctggaaaaaccggtatgactcattggtcttatttacttctcgaatgtacagctctttgccgggaatgcagcttgaaggagaccagcatggactcccttcaaaaaatgaaattgctgcttatctgaaaaaatatgttgaaagatttgaaatcccgatccgattacggacagaagtaataagtgtccaaaaattaaacaactatttcttaattaaaacaaaccgggaagaatatcaaacgaagaatctggtggtggccgcaggtccttttcatacccctaacattccatcaatatcaaaagatgtagccggtcatattcgtcaattacattcttcacaatataaacattcaaaacaactggcgcctgggaatgtactggtagtcggcggcgggaatagcggggctcagatagctgttgagttatccaaagaaagagttacatatttggcttgcagtaaaaaaccggtttatttccctttatggattggaaaaagaagcatcttttggtggtttgataaattaggagttttacatgcaagtcatacatcaatattaggcaagttcattcaaaagaaaggcgaccccatatttgggtatgaattaaaacatgcaataagacagaagaagatcatcttaaaacaaagagtcatagccggaaagcaaaatgaagtcatttttaaagattcatcttcattagaagtaaacaatgttatttgggcaactggttttaagaatccgctttggtggatgaaaatagaaggtgttttggataaggaaggccgaattatacatcaccggggtgtttcagctgcggagggattgtactttattggtttgccttggcagcataggcgaggttcagcgctgcttcaaggtgtaggaaatgatgctgaatacattgtaaaacaaatgaacggcggatagactgaggagagcagtaacttacgggtttactgctcttttttgtgttgaatacgtccatcagtgcaactattttagtccgcgcatattcagtttgaactaaatggattcacatggagcgcgtgcttcactcctcgttcagactctctaatttaattctttcaagtaaaagtcgaaatagctcaaataacaagaagttaaaaaactgcaaaccccgccgtatacgtatccgcccactatagagttcattaattacttgggaccatagaagaattgtcaatgtcacttccgatagttgtaaccagccaaaaaaagaaaatggggagggtgtgcttaatttgcacaatcttttatgtagaagtggcccaaggagccatcctgcattttgcattcgaatgaacctgtcgtaaaaaattgagagcagacttaaatatctgctcaactcgctgttatttctcaatgttgaatcggtctttgatcttttcaggcagtttctcggccttaatagcttcagattctccggtataaccctcatagctcctcggaacgcgtacaatgtcaccttcttgataaggcttttcaacaaagaaagaaaccatctttttcttacctttctcgttatacccttctaaattgtaaacgtagttgctattatttttgtttttttccgcttttccgtgaatttgtacgtaataatcgctttccagcacggcgccttgatcagcgcatcctcctaatatgaaaaccgataggcagcctaatataataatgaaaatgctcatgtttttcattcttcatcactccttttatatttcttattctaatgaacactgcatatcgaataaatgcggataccttacacttaccttacttttttgtaagaattcctgatataaaagataatgattcagttgcagaataacaaataatgggtaaatgcaatctcgtttggaaggagactgatatgatcattaaaatgactccattttttaatatgaaagaattcaataaaccaaacaaccatttgctgtctcaaggagaattgcacctgcatttgaaagcaatgtgtggaatataccgaggaacgatttgctgaaccttatgttaagaaaaatgaagatgatgatgtcagttacgttgaagaagaggggaaagcggtctttttttattacaactgcgccggccggattaagatacgttgcaaatgtaatagcgatttttgtctgaccattttaattgattggcagtcagtgaaaatagacatttgtaatgaatttatcgttgctcctcctaataagcggctttaactgccaagtttctgtttctcttcataccatttgcgaagctgatgaatatgagcttgatgatatctattatggtctgccatatgccatattccccattgaatggttgatgatttggtcctttataatcaatctcctgctgtgacatgtctgacacaatggatattaagcggctgtcattttcattaacggcagaatacagcgttcccacaagatgatccatgtgcgtttcaccttttaaatctaaaatcattaaccccacctcattagcacaattttcatatcagtttgccttattactcatatttgtcaagccatccggagaatgggccgctgtaagacgaagctatgaagcaggctctctttgcctgcttttttttgtgtcggctttacatctgacatgttgcgttatctgaaactgtacctttttaaatgtcagacagtgttatatgatactctgcagatattcaagaatatgtacttggaggacattctcatgcgaaattttaatgttgctatccctacgccttttcatgaagatgaaagtttatatttagaaggatttgatgctattgtcgaacatttgaaaaacagcggtatccattcgttactcatatgcggcacgactggtgaacagcattcactcagcatagatgagcgtcttcagatcattgagtatgttaatcagcgaaaatttgaagatgttgaactgatgttcggtgtttcagccgtaagaaccagtgatgccgtcaaactgatgaaacacatcgagaaaaccaatattgattctgtactgattggttttcctccttatataagaccgacacagcagcaagccgtttattacgttgacgaacttctcagtcatacctctaaagaggctgtgctttataataaccccggccggaccggttttaatctgagtgagaaagcgcttaaagacttaataagccggcatcccgggataagggggctgaaagaaggaggagacgttctgcgtcataaacaaacagagttccctgatcactttattttgtttgcggcaggagacgttgaatttccgaagatgctgagtaacgggtgtaacggcctgtcaagcatggccggaaatgtctatcctgaagaaatcagagaaagcttcagcagcttatcagaaaataaaccgattaatctggatcgaataaacgatctgattgctgaagtgacaaatcatcatactgtcatgaatataaaaaatcactataagaagattgggattcaagcaggcagctgccggtcacccattatataagaaatgttccgtcgcggataagtgaaacatgtgatcagcgcgctttctgtacttggattaggcttaataagcaagttttataatactgtcattagcgggggcgtaagcatttgtttaactttacataagggaacccttatgatatggtgattattgttaatattgacaagaaagaggtgaaagcgatgataacgatttatggaattttgtatggtgaaaatgcaaaaattggaaacatcttggcggataaagggagcagtctgtccttttttaagccaaatcatcatacaaaaacagttatcggtgctttttctctatgtcaaataaacgataatccaatgacataatgtccttgtttatttgtgcatgatgttatttaagcgtaacaccgataattgtgtcggtgtttttttgtgcctgattttaaaaaaaggttagatgatcactcccttctatttactcaaacaaaccagagttttatggaaggatgagaaaacatgcaacaaaaaaacaagtatataagaattcaagagttcctgaaacaaaataagtttcctgattttagaatgaatcaaatcaaaaatgctgtgttcaaagggagaataaatcattttaatgaaataacggttcttcctaaatccttgagaaaattgttaatgaatgagtttggagagtcaattttaaatattgctgctttaaaagtgcagcattctgagcaagtaacaaaagtcttatttgaaatttcaggagacgaaaaaatagaaacggtcaatatgaaatataaagctggctgggagtcattttgtatatcctcgcagtgcggctgtcattttggctgtgcattttgtgcaacaggagatattggtttaaaacgcagcttaacatcagatgaaatgactgaccaaattttgtactttcacttaaaaggacattcaattgatagtatttcttttatgggaatgggagaagcattagcgaatgtacaagtttttgatgctttacatgtgcttacaaatccggagttgtttgctttaagccctcgtcggttatctatttcgaccataggtattattccgggcattaaaaaaatcactcaggattatccgcaggtcaacctgacgttttcattacattctccttttaacgaacagcgaagcaagttaatgccgataaatgaacgcttcccgttattggaggtaatggacacattagatgagcatatacgtgtgacctcaagaaaagtttatattgcttatattatgctgccgggagttaatgattctattgatcatgcgaatgaagtagtacgtcttttaagaagcagatataagagagggaacttgttccatgtaaacatcattagatataacccgactgttagttcacctatgagatttgaagaagtaaatgagaaacaagttgtaaacttctataaaaaattaaagtcagcaggaattaacgtgaccgtcagaagtcaatttggcattgatatagatgctgcttgcggacaattatatggaaattatcaaaaaaataagaaccgataaatcaggtgcagaactcggtttgacttcatattatttcatttgataacataaaatggttattgtgattgaaaaaaagatacccgtttttataaaaaaggagtcataacgttgctgaaaaggttttttcttgtttttcttacgctgataatgtctatatttgctgtattcgcggctgctgaagagtctcccggcgatcgtgtcatttcttttgacgagcctatgattttattgatctcgctcggaatcattttatgtttgttcattccgccattcgtcatgtccttttttagcagcttggttgtgagaatcatatccggagtctatcaatgttttatcgttctcacgtttgcgggcctcattccgattggatttctgatccccaatggctttttgacaattcttgctgccgtcctgggaactttggtcagttcagctagtgttgcggtcaccttattcgttggcaggacagagaacacaaataagctttcgtaagcggttttgacaacaataacacgtcctgaaaacaccaagtgtcacagacccttggtgttttttaattccggcagaaaagaaggtataatgggcgggggagaggtgtcagccaatgaaaataaccagagagacattagaaaaacagcaaatttggatatatggtgcgactcttgtgatcggcggattagcggggatcgccgggaaagattcaggacttcgctggggatggacgatatcaccgcttatcgctgttctcatgtatgccatgtttgcccaaatcccattcttaaagctgagggaagccatgtcaaacctcaagtttatggcggctttactgatcggtaatttcttagctgtacctgtcgttgtatgggtgttaaccgccatttttcctcaatctcctcctatattatcaggggtttgtttggtattgcttacaccttgtattgattacgtcatcgtctttactcagctcggcaaaggaaatgagagattaatattggcttccacgccggttttgttcgccgttcagatggtattgcttccgttatacctgtggctgtttatcgggaaagaagtgataggggctgttcatgcgggaccgtttctggaagcattctcattgttaatagcggtgccgctgctggcggcggtgatgactcaattatgggctgataagaaaccggcgggagaaaaggtgttggaatggacggcgtggctgcctgttccttttatggctctggttttattggcggtcgtcgccacacaaatcggcaaagtcatcaatgatgctgacatcattatacgtgtgattccgatctatctgctattcctgctcattatgccgtttgtctcccgttttatcgcatatgcgttccgtctggatacaggtgaaggaagagcattgatcttcagcacgggctcaaggaattcactcgcagtccttccgctagcgctggctctgccggatgcttgggcctcattagccgctgctgttatcgtcacacagacgattgttgagctgatcggtgaattggtttatatcaaagcggtgcccggatggctgctgaaataaaaaataatctgcgctgaaaaaaacataccaatagatattggtatgttttttatgagaattataaagttgcaatatcaataacgaaacggtagcggacatcgctttggagaacccgttcgtacgcttcgtcgacttgatcggccggtatcacttcaattttaggagcaatgccgtgctcggcggcgaaatcaagcatctcctgagtctgcggaataccgccgacgagtgaacccgcaatgctgcggcggcccgtgattaaggagaacacactgtatgagtccggcttagcgggcgctcccacatttaccaatgtaccgtcaatgcgaagcagggataagtaggcatctacgtcaaggttcgcggatactgtatttaaaataagatcaaatcgtccggccagctcagtaaatgtatccggatcgcttgtcgcaaagtaatgatcggctccaaattcaagcgcttcgtcttttttgttcattgagcggctgaggacggtgacctctgcgcctaaagcgtgcgcgaattgaacggctaaatgtccgagcccgcccattccgacaatcgccacttttttgccgtgaccggcattccagtgtttcagcggagaataggtggtaatgcccgcgcacaatagcggactggcagcatccaaatccagctgatcgggaatacggacaacgaatctgtcagtgacaactattttctggctgtagcctccgtacgtagggtttccgtcgtagtccaggttattataggtctgaacaacgccttttgtgcaatattgttcgtctccgttcaggcagtattcacattccccgcaggagtctacaaaacagccgacacccacacggtcgccggcggcaaatgtggtgacttcttcacccacggcttccacaactccggcaatttcgtgcccgggaaccatcggaaagattccgccgccccattcatcgaatgcgctgtggatgtctgagtgacaaatcccgctgtacttaatatcaatcaggatatcgtgcggccgtaatgctcttctctcaatcgtcgtccgctcaaatttagctttggcatgcggagcgcttaatacacgagtcggatgattattgcacatggttatcttcctttccaagataaagtgatgaatcctctgttcggttttactttaaatgttaaagcggactttaagtcaaggggtttggtttatttttttatgaaatgatattctataatggcacgcttatgaaaggtatgaaggacgggtggtaagaatatgaagattgcgcaggctgcaaagcaggttgagttatcagccgcgacgcttaggtattatgaaagtataggactgattcctccggtaaaacgcgatgaaagcggcatccgcgattatgacgaaggtgatgtgaattggattcaatttataaaatgcatgagaagtgccgggctgtcgattgaggctctgattgaatataccgctttatttattgaaggagccgatcatacgatcgaaccccgaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggtttttttattttctaaagagaggaaacaaaacagctttttctatcttatcaatcattacttatccttttttcagcttgacttttttactgcagacttttaaagtgtgaaatgttgcttagactgtgatagcgactttaatgctgaaaagaggtggtttacccagatgaacaataaaaagaacccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcattattccgcagcagtttttgctgccggggctgtttatcattgcttgtttcatttctatatcgatgggaacatcaatgggcacgattgcggcggttgcgccgatcagcgccggtttgagcggagagcttggcatctccagcgcgataccgattgcggctgtggtcggcggagctatgttcggagataatctttcttttatttcagatacgaccattgcggcagtccggacgcaaaaaacacaaatgagggataaattcaaaacgaactttctgattgttttgcccgctgccattgtgactgttattatcttattttttattccggcaggccacgccctccatacggatgctgcatcttacagctggattaaggtgcttccttatgtcgccgtgttagtttttgcgttaatcggtattaatgtgatggctgtcatattcggcggattggttttgacgggaatcatcggattggcgggcgggagcctgacgtttgattcttattttaaagcgattacggatggagttgccggaatgagcgaccttatcatcctgtccatgctgatcggcggaatggtcggtgtgatgaaacaaaacggcgggatcgactttttactggagttcatcacgaaacgaatccgttccaaaaaaggcgccgaagccggcattgccggattggtcagcgtgacgaatctggctgcggccaataatacgatctcgattatcgcagccgggccgattgcaaagaatattgctgataaattcaacatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcccaagaaatacgaaataaaagataaaaaaaggcgccgttcggcgccttttttctttcatgacagccaagcatttctcaaaagctgtacgccttgtgtgatctgatccgtatcgagatgggcgaaacctaactttatgatcggcggttcgggctttccggcaacgaaatagacagcggtagggtatactttcactccgtactgaaaggcgcgttcgattaatgtttcttctgtatagttcaggtgaactcttactaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggcaccgtcaaacccagggtcttcaacgataattccggaaaaatcctctttcagaatctggctgagatatatcagcatctgctgggtgctgctgccgatgataaccgaatccgcatctgttttcactccgcgtgattccaagagataagcggcaatttgttcacgcaggtttctctcgccgaacggttcaccgtacagaaagcttttctctgatgccaaaacttgattgtataattttctccatgttttcagaggaaaatgcttttgatcgacggctccggcgcgaaaatcaatcagggccggctgagttgattcggttttctcagcgtaaacaacatcatgttcttgttgaaataaagagggttctatttcattagcaaaatatcctttgcgtgtttctccgcgaatgtatccctccgctaaaagcagatcataggccatcagcgttgtattgcggcttacccgcagggaatccgccagctcgcgaatggaaggcagccgctcatctgcctgaatatttccttgctcaatcaatgttttaaattgctcgtaaatttgtttgtatttcggggtgccgcttctgaaagcgaaaatcaaatttttcatcagatgttctcctctgacatgtgtatttatttgaaactgtatctttttaaatgtcagttgatattttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcggggggcatgccgtatgcaacccacctgccattgatgatgagtaagaataacgaatgcttatacggtcattttgcattgccgaatccccaatggaaagagattgatggccaaaacgtattagccgtttttcaggggcctcattgttatatctcgcctaaatggtatgagacgaatcaggctgttcccacatggaattatgtggcggttcatgtttacggagaggcggagcttttggatgaggaagaaaccgtgcagtcgatgagtgatctcgtattgaaatacgaaagccccgacagcccgtacaaattagaggatgtcgatgcgaaattgctggcaggcatgaacaaaggggtaaaaggttttaaaatcaaaatcagcaaaatagagggacaggcaaagctgagtcaaaatcattcagccgcaagacaagggctggtcgtacaacagctcaaacagattcctcatacaaacgaacagctcatttccggcttgatggaagaaaacatcaaacggatcaccgcaaaaaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaggctgaaacaaggccgaccgtcaaatatccggctgctatgtaaagataaataaaaaggtaaaacgggtaagaagacaacgggggtgtgtcttcctgtgtcatttttaaacccacataaaagaccaataaaaagcaaacggacgaaacgagagctaacaaaaggtgtttatataaatacttcttcatgtgtttcacctgcctatggacaattatttctaaacatattatgacatggttttaccgctgctgaaagaatcggcagcgggcatgcgcccgtctatatgagcggggcgtaaagaatcaatatcatcttttcatgaatccggatgttttgttcggatggatgtaaagaagaatacaccccaaaaaaagctgtcagcttggtcctgacggcttatttttggtgaaaggcttatttctccgtggtgaaataaagcaatgctatgaccggaaaagcgattccaatccataatgtgatactccacccgcctgaggcgtatgcccatcctccgattgatgatcctatagcgccgcccagaaagaagattgccataaataatccgtttaatcggctgcggaattcaggtgccaacgaaaaaatggcacgctgactgagtacgagattggcagatacccccatatccaacaggatagctgcggccaccagaactgctattccgacgggagagctgctctgaatcatgagcgggagtaataaagaaacgatgacaacaccgagagcgattccggtggcaagccgggttaagccgcgatcagccagacggccgcctatcggtgcagccgctgcacccgcaatgcccgctaatgcgtacagcgcgattgccttttgagaaaaatgaaaagcaggaccggacaatagtaaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggccgcgtgcggcatctggtgcaaggtatgatgcgaacggaactagcacttgggccgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaaccagttgaaatcccctgatccgctgtttgtttattttctttagccatatgaatgaactcctttttaatgattttatgaggtttgataaatattttgctgattcatctcctttacgcagaggcttttggagtctgcatttcatcaagacttccctcaagttattttataaactaaacgttcagttttgtttataagtgaataatatactaaacgttcagttttgtaaatgggtttctgttttctttttttatacaggttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgacccacgccgcgaatttagcaaggtttttgacgagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgacgtaagcatcgatctcatttacggaccgattttctatcgcctgttgatcacaggtgatgaggtgaatgattcctatgtgcatgatcttgtgatgagtgcgtttaagggagttcaagctacgtgaataaccgccgctcgaatcgggtgaaaagtatttgtgcctatggggcagaaaataatgaaaaggcagaacaaattgttctgccttcttcgctctatttgcgaaccgcccggcggccgccacgcacgtaatcaccgccgcaagccccaataacagcccgaagaaaggctggagaagctgcagagctgattcgcgggagtttcgttgcctgggcgctgtaaaggcagttctcagtttgacatactgaagctgagccagaggtgctgtctcagcaggaaagcatttataggacgggcaggcggagcgccgtatcaatattttgcaaattaaaccggacttgttcatctgtgttccacggatgataccagcctttttccatcatatagcgtgagatttgctcatgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaggtattcaataatcggattcattcgtcattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcaggcaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgttcttcgcttcactgagcggaatgacatggcttacaacatcacccgggtcaattttgccggttgacaccagttcaaacatatacggcatataatggataaccggagcttgtcctgatcggatattgacgttccgctgcatgatatcgccaaggggaaacccgttgtatctgccgccgtacacacccgtaatctggatcgttccgccttttcgcaccgcttgggacgcgatgaccaatgcgctcatggccccgccttgaagttttaatccgctggcgaggaactccaggtccgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctattacgcgtttcgcaccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtaaagttcgcaaaagggacgcgcaaatattcggcctggccgcccggatagccgccggtactccctgaatagccgaaataagcgcccatatcgccgttttcatttgattgatcacattggctttccaggtgatttttacaataagtgcattctccgcaggcaatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgacgacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtctgtaatttcctgatgcatcgcgattccttgcatgagctgtttgcgcagcaaagctcttacatctggcgaggcggtttctgtcaaagcgacggcggtatttctgacgccttcttttgcgcgtatgagaaaatccattgcgaatgtcatatctgcgagttcagggacgtgtaatgaattgattggatctaaatggtcatggttcaatgatgcttaccttcctttcaattgatgatcgaagtcggccggttttgaggaacaggagcctgaaacgttgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgtcttttaaacctcctcttctcaattacataattaatttcccctgagaaaagagctctagtcttacaaattttgtttataaaaaagagagaagaaatccgacggtacattaaaaaagaggaagcacaatcgcctcctcttgttcacatggaatggctgtcggtgtcctgaacgtttttctgatgcgcgggcggttttgccctcgcgggagacgagaccgctgaaacccgggaaaggtcataaaaaagatatgaacaaaagcagcttgcgaacaatcccgcaggctgttttttctttcacccgtcatgcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgctgtgctgcactggcattcctatcgctgggtcaagaaaaaaacgtttctttatttcatcatacagggatttatcatatatacatcggctaacttgatgaccggcggctatatcgcggcggtcatcggtctctatgcctttttaatcgggcagattatcggaatggcggataagggcaaaacgccgctcatactctatcttttcattttaatgtccatagcagccctgcaccaggagcatccgcatcatctgcttcgtttcatcgttatcgccgctcccatcatgatcgtgattatcacatatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggacagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgcctttacatgattggcgaaggcctgactaacgccgccaagcatgcagaagcaaagaatgtctgggtgtccgttcaggaagaagagggacagatccgcataaccgtcaaagatgacgggaaaggctttgatgccggaacagaaatgagaaaaagcggacattacgggctgctggggatacaagaacgcgtcaatatgatgaacggcactttccgtataacaagcgccagatcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgcctcgcagcggaactaaagcccgatgtcattctcatggatctgtacatgccggaaatgagcgggctggaagccattaaacagataaaagagcattctgatgtgccgattattattttgacgacctataatgaagatcatctgatgatagaaggcatcgaatcaggcgcgaacggttatctgctgaaggacacaagctcagaaaccttatttcatacgatggatgcggcggtcaggggagaagtgcttctgcagccggacatcttgcggcgtttccgggaaaagaaaatggaacgggcaaatgccaatgaaacacagctgacggacaaggaaatcatagttctgcaagccgttgcgaaaggacataaaagcaaagcgatcgccttcgatttaggaatctcagagcggacggtaaaagcgagattaacatcgatttataacaaattaggcgctgattcgcggacggaagccgtcaccattgctatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacaggaagaaattgacgtcaaaaccggaaaaacaagcgattgaagagacattaaagaagatcaaaacagatcattcggtcgcttcgattgcaaatccttttgaaacaggaaccatttctaaagacgggtcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacgtttggttcattagtcatagcggggctgccgattgtcacggccctgatcgggttaggtgtaagcgtcgcgctgacgttaattgggacacagatctttacgatagcctcggtcagtctctcattatcaggaatgatcggcctggccgtcgggattgattatgcgctgtttatctttacgaagcatcgtcagtttttgggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggttcctgcggtgttgtcaatcgcaggaaaacggatgattccgaaatcaaacaagaagaaagaaaaggaaagcgccgacacgaatgcctggggacgcttcgttacaaagaagcctattctgttaagcattttcagcattattcttttagctgtcatcagtctgccggccatgcatttagaactggggctgcctgatgcgggaatgaaagcgaaagacagcccggaccgccgcgcctatgatctgttgtctaaaggattcggcgaaggctttaacggcaagctgacaattgttgccgatgcaaaaggagtcaaggggaataaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagagttagtgcaggatatacggaaacgatcagacaaaaacggcatccgcctgctcgtcaccgggtcaacagcggtgaatattgatatttcagaccggttaaacgatgcgattccgaaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatgggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggtatggagacgtgtccctttttcaaaagaaacatgatgggtttttaacggcggatctttttcttggtcatgcttaatgtcagcaaacgaagcgtgtgccaggtcttgatataaagttcccccgtaagtaacgtttaacatatgcatcccccggcagatggccagtatcggcttttctaaagcaaccgccgtgagaatcagctccttttcgtaggcgtcccgatcaggaaaggtctttcttaaagcctgtaaaggttcttcgccgtaaaacagcgggtctatatcctggccgccggacagaatgatgccgtcaacatgagagacctgttcctttaaaagcgccgtctcttgaatcaccggcaatataaacggcacaccgccggcctcagaaacagactgaatataatcattattgacatatgcccgattataacccgggaaagggccggattgatcagccataatgtttcccgtaattccgatgcgtttggccattctgcgttcacctgaacctttctttctgaaccttctcgtatgaatctgaacgtaggttgtacaaatcagtttgaaattattcttcataatacgtgaactttccaaaacaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaaactttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcccccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcgggggttttatcaagcggaaggtcgaatacttcctgggttaaatagccgacgtttgcagacggagaaatccatatgccgccctgcgctttttcctgaccgaggatgaccttcaataatgttgttttcccgctgccgttcgggcctgtaatcgcgatcttttcaccgtgcatcacagtgaaattcacgtttttaaaaagcgttcggccttcatatgactttgtgacatcacttacttctaaaaaacgctttcccgcttttttgcggtgctcaatggaaaaacggacttcatactccgcttcaaccggttctgctttcgctttttcaagctctttttcaagacgcttctgctttgatttaatctgggcgtccgtgcgttttgcttttacgcggtgatattctttaaagccttctattttcgttgattgggcgtgggctttttttgaccaggcgctcagctcgttcatttgagcttcaatccgtctgatcatatgctgctgattctcatattcccgctgctgtgtcagccttctctgtttgcggacctccatatagcttgaataattccctttatgttcaatgagtttctttccttcgatggcccagatttttgtcgccgccgcatctataaaagcacgatcatgtgaaacgaaaataatggtgcctttgtaattcttgatctgattaagcagtatttctaaactgtgctgatcgaggtggttcgtcggctcatctaataacaaaaggccgcttgaggaggagaaacctttggcaagacgggctttcaatttttctccgccgcttaattgcgaaaaggcgcgtgcgggcacgttccacttttctaacaaggctgcctccgcaggctccggatggccggaatcataagcttccgtttcttgttccaccatatatatgttcacatcttgcatcatctggatctgtccttgtgacggcgcttttttattgcagatcaattgcagcaataaagatttgccggcgccgtttttaccgataacaccgatgatgtcgccttgctgaacactcgcgctgatctgttcaaaaaggggaacgctgttgatttcgtaactgatgccgcttatttttaacatttctttcatatgtcaatccctcgctttaaagggaggacaaaaaaatcctcccaattgatttggaaggattagccgtacctgtgcgtgatcaaataagctatttttacatagctttctcgtatcgtatagaaaatgggcagactaatcctattttttctgatttgaaatatttgatttcaaacggtcaaaataagattagttaatcattgtccacccatcatcccttcgtatttgttacgaacagtgtagcacacacttatctgtaaaagcaaagggtataagcctttttattccagatcggaggcttcccactcttcttctaaaacggcataataatattcatcccaccattcattatcatgggggatgcattttttaaacaagccttcccgcctcatcccgatcttttccatcacccggtgcgaagccatgttttccggctgacatgtcgcaatgatccggtgtaatttcatcttgttaaacccgaatgccagcacggcgcgcgccgcctctgaagcatatcctttgccctggtattccgggtgaaacacccagccgatttcatacgtatgatcgccaaaatactgaaaaaaaacaatgtggccaatgaccgttttctcatccttcaataaaacgggaaacttcccggcatgttcaccgctgttttcagtaacgaatttcctggcatcttcttcggtaaagacaccctctggtatatatttcatgacactcggattcgaggtgtacgcatagacatcctgccaatcttccggttcaaatgtccgaatgacgagcctttcagttttgatattcatttttttatgttcctccatcaaaaaaggtttcatttactacttcgattgaaagatgtaaaaaacctttgagcggggaagagccgaataaaaaaagcctgcagctatacactgcaggcggttatttttcatttgcggcggcgggcaggtttgtaaacccgaattgccctccgacagcttcttttacttcatgaataacgataaatgatttcggatcaattttttgaacatgttttttgattttcagcaattcgttctttttaatgacaacatagataatgcgcttgtctttgctgccgtaatacccgtatccgtaaaatatcgtcgccgcgttgccgtactcggaggtgatggctttggcgatttcttcgtattggtcagacataatggtgagggcttttttattatggaaaccctcaatgacaatatcgacgattttggcgcacagataaacgaatataaacgtatacagcatatgattgattccgatcgctaaaacggatgcgaaaatgatgacacaatccatataaaacatgcttttggagatgttaaagccctttgtgtaattcaataaatacgccaaaagcgtggtcccgccggtagatccgtcagcgataaagatcaatgccagccccgctcccatcagcagagcgccgaatacaatcccgagcaccatgtcgtgcacgccgaacggaataaagctgacgatgctgagaaaaacagaagtcattcccgtaccgagtatcgtgtataaaatcgtttttttcgttaaaaatttataagccagcccgataaaaatcaaatttacaaccagagtcgtaatacttgcaggtatatggaaaagataatataaaacgagagcgattcccacggtgctgccgtcccctaaatgattcgggatgacgaaaaattccacggacgccgcgataagaaaggctccggccataatcatcagtatatccttgcaaatgttcttcatgtgcaaacctcctccgcagtcaaaaatatatataaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgccgtgaaaattgattttctgcagtgtatatgaggtttaaaccaagttaaaacgaggaattatatcagaagagttttcatttccgctctatcaataagagaaatgtaatgagagacaacgaagaagggatgatgacattggaacgaatttttatcagtccggccaaatacgtgcagggaaaaaacgccattgaaacgatcggcggacatctggagggcgttggtgaaaaagccgtcgtcatcgcggacaaaaccgtatgggatatcgcgggccacaaggtgacggctgaattaaagaaaagcaatatctcttctgaagaggcggttttcaacggcgaagcctcccaggaagaaatgaaaagaattgccggcatcgcagaaaaagcaggggcgactattgtcatcggagtcggcggcggtaaaacgcttgatacggccaaagccgtatcagatgaaataaacggctacaccgttatcgtgccgacggccgcttcaacggatgctccgacaagcgggctgtctgtcgtgtattctgaacaaggcgcgttcgaaaactatcgtttttatcataagaatcctgacttggttctggtcgatacgaaaatcgtcgcggaagctccgccgcgctttttagcatcagggattgccgatgcgatggcgacgtggatagaggcgcgcagtgtcattgccaatggcggtaaaacgatggcaggcggaattccgacaatcgccggagaggctatcgcggaaaaatgtgaagcggtattattcaaatacggccgtctcgcttatgagtctgtgaaagcgaaagccgttacgcccgcattggaagcggtggttgaagccaatacacttctgagcggactgggatttgaaagcggcggcttagctgcggcacatgccattcataacggatttaccgcgcttgaaggtgaaatccatcacttgacccatggtgaaaaagtggcattcggcacgctcgttcaattggcgctggaaaaacgttcgcttgaggaaattgagcggtatatcgcgttttatatcagcttggggctgcctgtcacacttgaagacatcaaattgaaagacgcatctaaagaggacattatgaaagtggcagaagccgcgacgattgaagaagaaacgattcatgccgcttttgacgtgacggctgacgacgtggcggatgccattatagcggctgatcaatacgcaaaagcatttaaagaaaaacacgcgtaaaaccttttaccgcgtgacccggaaccaagggctgttacagcccttggttttttatgccctttgaaaacttttaaaaataaagaaaaaattatgatacaatatacaaatgttttgagagattgacaaaggaaaggtgggaacgatatgctgcataatccgaccggtaaggagcggcttgcgctggcttttcttctcggaatgcttgcgatactggggccgctcaatatagatatgtatctgccgagtttccctgaaattgccgaagatttaagcgcccgcgcttcgcttgtccagctcagtttaaccgcttgtctgatcggactgacaatcggacaggttgttgtcggcccgttaagtgacgcgaagggaagaagaaaaccgttattgctatgtatttttttatttgctttgttttctctgttttgcgcgcttgcaccgaacatttcaacactggtgattgcccgttttcttcaaggattcaccgcttcggcaggactcgttttatcccgtgcaatcgtcagagatgtgtttacgggaagagagctttctaaatttttctcgctgctgatggtcattaccgccgtcgcgccgatggtggcgccgatgacgggaggcgcgattttattgcttccgtttgcatcatggcatacgatttttctgtttttaacctttatcgggtttttgcttgttctcatcattgcgctcaagctgacagaaaccctgccgccggaaaagcggattccgagctccatcggaaattccgtgcggacaatgggaagcctgctgaaggatcggtcatttatcggctatgcgctgacggtcggttttattcacggcgggagctttgcgtatgtctccggaacgcctttcgtgtatcaggatatttacggagtatcgcctcaggtattcagtgttttattcggcataaacggtctggcgatcattaccggaagctttatcatcggccgtttcggcgggatcattcacgaaaaaagcctgctgagaatcggcgtgattacagcgatgacggcgactgccgttctgctcgtcatgacgatcattcacggaccgctggcggcactggtgatttccatttttatttatatgattacgatcggcatgacgctgacaagcacctttacattggcgatggaaaagcagggacaccgcgcgggaagcgcaagcgcactgctcggcatgcttccgcttcttctcggttccatcgtgtcgccgcttgtggggatgaatgaagcgacggccgtgccgatgggggcaattatgttcacgacatccgttatcggttccatcgcttttttcgccttaacaacaaaaccggagaaagcaaaaaaggagtgaaatgattcactcctttttttgatgcccgctattcatatttcttcagcacgatcgccgaattatgtccgccaaagccgaatgagttggaaaggccgatcgttaacgattgatggcggggcccgtctgacacatagtccaaatcacatgccgaatcagggtgctgcagattgatcgtcggcgggatgatgccgtgtctcaggctttctgtcagagcgatggcttcaacgccgcctgccgcgccaagcatgtggccgagcattgatttgttggccgtaaccggaatgtcatacgcaagctccccgaataatgttttgattgccaatgtttcagaaagatctccggcttttgtgcttgtcgcgtgggcgcttacgacatcaatgtcttccgctgaaacgttcgcctttttcaaagcgtttttcatcgccaggtatgcgcccgtcccttccggatgggaggccaccatatgatacgcgtcagagcttgcgccgtagccgagcacctcacagaggatcggggcgtttctgccgattgcgctatccaatgattccaatactaagatgcccgcgccttcactcatgacaaacccatcgcgatccgcgtcaaacggccggcttgccgcggcggggtcttcgtttctcgctgacagcgcgtgggcattcccgaagctggctaatgacaaattcgtaatcgccgcttccgctcccccggcaaacataatatctgcgtcatcattccgaatggcgttgaatgcttccccgatcgacgtattgccgatggaacacgcggtgacgggagaaagtgaggggccgagcgcgcctaatctgatgctgatttgagcggcggccgcgtttgagatcatcatggggacaaggctcgggctcacttttcgcgctccccgttcatttaaagtatgaacgttatcaatcaaagtcgtgatgccgccgattcccgagccgacgtacacgccgaggcgttcacggtcaatctgatcgagctgaatcccggagctttcaagcgcctgttccgctgccgctaaagcaaactggctgaaacggtcaagccgtctcgcttcttttctgccccatctttcttctgcgtcaaaatcacggacggtgccggctatttttgtcttggagccggagacatcaaacgaatcgatgagagagattcccgatgttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttgattatcctagtataatgaataccagggtaagagaggagagattcggtatgataccagaaggaagattgcaggcgctctcagagtttttaaaaacgcagcgggccaaaatttctccgcagatggccgggctgccgatgggcacacggagaagaacgcccgggctccgaagagaagaggtcgcgcaattagcaggcgtaagcaccacgtggtatacgtggctggagcagggcagagacattaaagtgtccgcagccgtattggacgcggtttccgatgcgctgcagctcaacaaagatgagagaaattatttatacgcgcttgccattgaggagggcgtgaagcagccgtttgccgcggaggaagaagcggttatcagcccgtcgctttcaaaaatcctgcaggagctccgttattgtcccaccattatctcggacaggcgctgtcatatcgtggggtggaatcaggccgcggctcacgtgtttttagattttgaacaaattcctcctgaaaaacggaatctcatagagctattgttttccagaaaagaattaagaagtttagccgtgaactgggagcactttgtgaaaggattcatcgccattttcagaacgtattacggccagtatgtagctgatacgtggtattctcagtttatagaagaaatggagaaaacgtattcggaatttcatacgctgtggaatgagagcgaagtcagctcggcacccgaagtattaattgagttccgccacgcgaaggcgggaaaaatggtctttaacctgacttcatttcaggttcagggcaacagtgatctgcgctgcagtgtgtatacgccggtagatcataccgaaacggaagcaaagctgaaaaagctcttcgaaaacaggtgaagaacagaaaaaacgggaggcggccgcctcccgtttcagtttaaaataaaagcatgagaccggcgatggccggtgttaaaaagatggctgatttcagaatgactttcggcacgtggttggtgaatttcgctccgacatatgcgccgcacatcgtgccgatcagcactttgaccaacagtatataatcgacaaatccttccgtcacataaccgagtcctccgccgaccgcaagcgggataatgacaagcatggtggtgccgaccgactggcggatggataagcgcaaaagaatcattaagccgatctggatgaaaggggcagagccgatcccgaacgttccggacaagattcctgcgatgataccgagtacaacggctttcacccatatgttcagattgctttgccgtccggaatcttcatgtgtttcttttacaataaataaccggactaaaataagcagagcggataaaaacagcatgcccgccgtcaagtaatgcagcaaatctgcagggataagggaagtaagccttgccccgaaaaacgaaccgaatgccgcaaaaacgccgacgatgaggccgattttcatctgaatattgccttcacggtagtggctgaaagcccccgataaacttgtgaaagccattccggcgagggaggtgcccaaagccgtatgaatcggtacgtgaaacagtatagttaaaagtgcaatgacaaaaccggctccccccgcgccgataaacccgagaataatcccgagaaggaacataacgagtataataagcacaatcttctcctccatttagatgcctgatcaccaagttcagatccgctttatcaggtttttaacaatcgatcgtcgtccgtcgaccgtcgtccattatctttatgttacctcaaatttgagggattggcaagaagccgaatcgcttttatacagagggtttacagctctttcaccatcactttttccccgtttgagtccagctctccattgaataagaagccgaatttttgataaagccgcaatgcgtgcacgttatcttcaaacagacttaaataaatccgtctgcactcatatattcgaacgagatggcggataagagcatcaagcaacagcctgcccaatccacgtccctgataacgttcatcaataaaaaaacggtcaagccacactctgccgttttcattttcctcatcatattccggaaaccatccgtacatggcaaagccgaccaattccccgttaacataaagaccggccggctgataatgccggcaatcctcagcatcttgtaagcactcttccgcggtttcaataaatgaagtctggctttcccttacatgaagcgccagtatatcagcacggttttcttccgtgactgctctgatttcaatcgtcatacttgatactcctcttctgctttttctgagacggtaaagctttcattgcgtaagccatttgtgaatcagccttctctcggatacaatgatcatcataaaggatatggttaccgtatagtcaaggaggcattatgagcgaagacgtcagaaaatacttcacaacgggtgaatttgcaaaactgtgccacgtaaaaaaacaaaccctgttccattatgacgaaatcggcctgctttctccggaaatcaaaaaagcgaacggatacagatactattcctatcatcaattcgaactgttccaggttatcggtctgtttaaggaggtcggcgtgcccttgaagcagatcaaaccgctcttaacagacaaaacccctaagggtatcatcacgcttttaaaagagaaatcatcagaaatcgaaagcaaaatcaaaaagctggagcacctgcaaagaatgattcagacaaaggtgaagctgaccgaacaagctttggagacagacttctcctccgtctcattgcagcgattagatgaagagacacttatgataggacgacccgtactccatttgccagaacggcaatacactgcggccatttccgaattgatccgctatatgcgggtacatgaactcgatcaggggcatccggtcggcggactgtttgcgcgggagcagattctgaaaaaagaattctacaactacacccatttttatatgaagacagaagaaggcatagagaatagagacctccatatcaagccgaaagggctttatgccgtcgggtaccaaataggggatgaagcggaagcggcttaccgcagcatcatgcagtttattgaagagtatgggctggaaatgggcgattatgcatatgaagaatatatgcttgatgaggttgtggcggacgggtttgacaatcagatcacaagaatccagctgcaagtccgcaatcgataaagccgatgccgccgttcgtttacgtcttctgacaaaccttgtataatgagaaaaatcagattgcaattgaggtgaaaaacgatatgtttctagcacccttatttgaacatgatgtaccggaagcacttctccgcccttaatggaggaaagtgactgcgcttctctccgttagggcatatgacgtgacctaatatgataacggagggtgcatcaaattgaaaaatacattgttcggttcgatttatttggcattggccgccagtatctggggcggtatgtatgtcgtcgttaaagtagtggtagcggtcattccgccgcttgaactggtatggctgagatatgcggtggcgcttttttcgcttttgattctcagtttatttacacgccaatcctggaaagttcataaacgtgatttattactgatcgctgcgatcggattgatcggcaacacgatttcgatcgtcacgcaggaaatcggcacgaaattatcaaccgcgcagatgggtgcgattattacggcatccactcccgcatttatggttgtatttgcccggctgattttgaaagaacggttaacgctgaaaaaaggaatatcgacagggctggcgacgatcggagtattgctcattgtggggaacggagatctcaatatgtcgagccagttcggcggtctctcgcttctggctgcggcgctgacatgggctttgatgtccgtgctgatgaaacgggttcccggccattactcaccgcttgtcgtcacaacgtattccatttgcgtcgcatttgtcatcctgaccccgtttacagcgggcccgcttcgggagattcctttgtctcagcttgcccggcctgagatatggggcggacttttatatctgggtgtgatctcaaccgcctgcgcgttcatgctttggaatcgcggattgcaattgctgaatgcggcaagcggcggtctgtttttcttctttcagccgctttccgggacattgctcggctggctgctgctgggagagacgatcggaggaaccttctggatcggggcggcacttattgtttcaggcgtcgttctcgtcatgaaagaaaaatagaaaatgaaaaaaagccattcagcaaatgaatggctttttctgatttcccggcaggattcgctccgccataaacagaaaacaaggagcagaaacggatcatgggcaccggtactctcaaggtgcaattcggggtttcgtcaattaacataaggcggtgaaaaaatggagccaaaatggcttgaatgggcaaaacagcttcaatccgcggcgcaagcggggctggcttattccaaagacatatatgatattgagagatttgaagaaataagaaaaataagcgtggatatcatggcgcaacataccggcatcgacaaaaggatcatcaaagacgtattcgccggtgacactgggtatcccactccgaaagttgatatcagagcggcagtttttaaagatcagagcatattaatggttagagagaaaagcgacggcagatgggcactgccgggcggatgggctgatatcgggatttcaccgggcgagaccgctgtcaaagaagtaaaagaggagtcgggaatcgacgtaaagcccattaaactgttagctgtaatggataagaaatgccattcccacccgccgtccgccgcccacgtttacaaagtgtttatcagatgcgagatcatcggcggccggctcagggagggaacggaactgccgccgctatctgaagcccgcaatacggaaagtcagattaaaaagatgttcgcatatctcaaacatccggacgaacccgtttattttgattaaggcagcaagcagaaagaaaagggggcccaagtataatggaggattcaattaaacagcaggcgcagcggcaatttgctaaaaacgccgcgaaatatgtgactagtcccggacacgccgcaggagaggatttggcatatctcatttcagcttccggtgccgaaaagcatatggacgtgctggatatcgcgacgggaggcggacatacggctaacgctctcgctcctctcgtacgctctgttatcgcatatgacctcacggaagaaatgttagcagccgctgaagcatttataaccggaaacggatggacgaacgtgtcattcgaaaaaggtgatgctgaaaagatgccgttttccgatgctgctttcgatatcgtcacatgcagaatcgcggcgcatcattttcccgatgtcagagcctttgttcatgaagcgtttcgggttgtcaaaccgggcggcagactgcttctcattgacaataccgcacctgaaaaggatgaatatgaccatttttataatgacattgaaaagaaacgggatcagagccactttcgggcgtggaaaaaaacagaatggcttcgttttctggagacagccggcttccggattgaatccgctgcctgctttttgaaaccatttcaatttaccgtctggtgtgaacgggcaagcctgactgaagagaaagccgcatcactggaaaaacagatgctggatgctccttgtgatatacagcggtttttttctgtagaaaaggatcaatcaggccgtattgcgggcttcacaggtgaatcggcctgtttctgcgcgctccgtcccgtctgagacgaaaaaaccgctgtgcagttttcctgcccgcggttttttcgtattaactgttcttgatttgagaaataatagcggaagtgacatcttcagttgaatgttttccgccgacatcaggagtcagaatgccgctgtttgtgaccgtttcaatagattgtaagaggagatggcccagttcctcttctccgaatgaatcgagcattaatttcgccgtccatatttggccgataggattggctattccttttccgacaatatccggggcggagccgtgaacaggctcaaacatggaaggatatttgccgtttacattgatgttggctgcgggagcgattccgacgcttcccataatcgccgcgccgatatctgtcagcacatctccgaacagattcgaagcgacaatgacatcaaagcgttcgggctgcgtgacaaagaaggccgccagtgcatcgatgtgctgggaatccgtctcgatcccggcgtactcccggctgacctctttaaagatgtcatcccagaacggcatcgagtgaacaataccgtttgatttcgtcgcgcttgtgacgtgtttccgccgacttgccgccagttcgaaagcataccgcatcactctttctgtaccccggcgggaaaagaccgcgttttgtatggcgatttcgtcctcaccctgataaattctgccgccgacagagctgtactcgccctcactgttttcgcggacgactatcagatcaaaatctttcgggtttacgaggggggaagtgattcccggcaggagcttcgccggccgtacattaatcacctgttcaaattcccggcgtatcttgatgagcagcccccacagcgaaacatgatcggggacgagtttttgattccccaccgctcccaaaaacaaagcatcaaagtgctgtaacgtttctaatccatcatccggcatcatagtcccgtgctccaagtaatactcgcagctccacgggaatgaagtgaaatcaaaggcaatgcctccatgtaattcggcgatcgcgttcaacacccgctccgcttgcggaacgacttctttccccacaccgtcccccggtatgctggcaatcttgtatgttttcatgtttccgtcacctctgaatgaattgttttcggcttacggcagaccgtcgaccgacgttcgctatacttccatattacggcacctccgttatgctgacaagctctggaatgttgcttccatagataaactgttatatgatcttggtaacaataaggcctaaattgtatgaagaggtaggaaagatggataattttaaattagataagccaatcccgtattatctgcagttttattcccaattgaaaaaaatgatatttgacgggatttttaaaccgggtgaacggctgaatgagactcagctggcgaaggatttcggagtcagccggtcgccggtcagagaagccatgcggctccttgaaaaggacgggcttctgacggcagacgatcgaaacggctttgtcatttattctttgtccgttaaggatgttgaagagatttatcaaatcagaatgtcacttgaatcattggcggtcgaactggttattgatgaagcggctgagagtgaaattgacctcattgaaaaacagctgcgggagacggaagaagccatcaataaaggcgtcaaagagactgagattatttccttaaacgagtcgtttcatcggctccttgtggatttcagccgcaacagccggctggccatgctgcttgagcatgtcaatgtgctgattcatttttgcagagttcttaattttaaaggagatgaccgtgcggaggttatcctgcatgagcaccggaaagtctttgaagaaataaaaaagggcgataaaacaaaagccgtgcaatatatgacggagcatctcaagcatgatgaagaacatctgaaaggtgtgctcaaagcgggtgaaacagacgaatcatcacgatagacaaggtgaaaagccttgtctttttttgccgatgtcatcgaaccgtcataaagacctgacgaatgttccttgcatgattttttccgcgtcatttatgatgggtatggaagagacgcaaaaaaggcaaaggagtttgaaaaatggcgaaacatattctgatgatcaattttcccgcagaaggacacgtaaacccgactttgggtatgacaaaggccttcagcgaacggggcgatcacgttcattatatctcaacggaaaaatacaaaagcagactggaaggagtaggagcgaaagttcatcttcatagcgatctgctcagaatgacacccattgatcccggcagtccgtccggcatacttgcatttttaaaggttcatatcaaaacgtcactggagattttacatattgtgcagcggctggcagaggacattcaattcgacgccgtctattatgataaattcggtgcgggagagctggtgcgggattatctcaacattcccggcatctcttcttcagcatccttcctgttcaatgaagaccgtctgaaaatactgccgctccatccggaatcgggcgtgccgtttcagccggacagggaatgtgaagagctgttggcggagatgaaagacaaatacggtgtcgcccctgacagcatggttcaatttatgaacaacacaggtgaattgaacgtcgtctatacaagcagatattttcagcccgaaagtgagacattcggagatgagtatttatttatcggtccgagttttccgaagagaaaagggcgcgtcgacttcccgattgactcattaaagaatgaaaaagtcatttatatctcaatggggacggtgctcggggacacggaagcgtttttcaatctgtgcatagacgcgttctcagattttgaaggaaaagtagtcattgccgccggggaaaaagccgatctgtcgaaaatcaaacaggcgccggaaaactttatcatcgccccgtacgtgccgcagcttgaagtgctggagcaggccgacgtgtttgtcacgcatggcggaatgaacagtgtaaatgaaggcattcattatcaagtgccgctggtcgttattccgcatgataaagaccagccgatggttgcgcgccgcctgactgaattggatgcaggctgtacagtgcaaaaagatgaagtgagcgctgaaaaggtaaagcttgccgcggaagaagtgctgcataacggaaaatacaaacaaggcattcaagccattaatgaaagctttaaagaatgtatggacatgaaggatgttctggcccggatcgaccggtttattgaacaaaaacatgctcaataatacatggaaaaagcctgtttcctctgccaaagggaaacaggctttttataatggcttttagatgatgtgatgttcttcatttgcaagtttcacaagagtcagaagagattctgcctcatgtgcgttgagtgtttttgccagacggtctttttcaaagatctgctggccgaagacattcactgacgcctggtcaaccgccgtgtgccagttcttttgtgaatgattctcggaaaaagagaaaacaaacacggcaaagaccgctataagcatcgccatgacccaaaatttttgccgttttcctgctgctgacataggccgcctcctaacgttcattttactggtattagatcatatatgagctgtttttcatagagtaaagaagtcattatttcaggtagtccaaatgaaacggagcacagccgaaagcccgccggtcaggccgatgagccaattcatattttgttcatattttattaaaagtttatccaagcctgtcctttacagtggatataaccataaaacgctgctgaaaggggccttgaaaaatgcatattcatatgatcaacaaaaaccagtttgagagtgacttggaggcggccggcttcatccgtcaggcagatgatattatcggcaaaatgaaagaatacgtaacggaatacgccgcttcatccgaacggtttctgattgaaattcaaaccgtcatgaacgaatacaaagccgtcgtctgtgcgatgttttcgactatggaaattgccggcgcaaaaaaagacgagaagcatgttgagttcgaagcctgcacagtgttgtgcgaataaaagaccttcattaaacctccgcggctgcctgaacggcagtttactgactggtgttccgggaaggaaaaatattgaaacttctaaagcggctgttcgtataaaagagtaaatcagcttgtatatggaggttcgtgaaatgaacgataagaaaaaacaagcttttgaacagcttttcagcactttagacgaaagacatgaaataaacggagctgtattggcagcggaaaacggccgcatcttatatcagggttcattcggcgctgcggaactgaaaacaaagaggatgctgaatgaccaatcggtctttgaattggcctcagtatcgaagccgtttacagctttaggcgttatcattttagagcagcaagggaagctgcgttatgacgatatgatagagccgtggcttcctgattttccttatccgggcattaccattcggcatttactccatcatacgtcaggattgccggactatatggagttatttttaacacattgggaccgggacagaattgccgttaatcaagatgtgatcgatatgcttaagcagcataaaccggatgcttatttcccgccgggcaaggagtggctatacagtaatacggggtatgcggtgttagcggttattatagaaattgtatcaggcatgagttttgctgaatttatgaaacaagccgtatttcatccgcttcgtatgcacgatacgcggatttataacagaaggctgagtaaagaaaacattccaaactatgcatatggctatgtgtatgatgttcattccggagaatatgtgctgccggatgaacttgaggaaaccgattatgtcgtctttcttgacgggattcaaggtgacggaaccgttaactccactattagagatttatatctgtttgatcaggctctttatacggaagaaatcatcggcaaagagtctaaagatcaagcgtttacaccgggctattggaatgaagaagagcaattcggatacggatttggctggatgattcaaaacagcgcccaaaaagggaaggttatcagtcacgacggaggctggccgggctattcaactctgatgatccggtatattgaccagaacaaaacactgatttatctcagcaatatggaacaatcgtatcaatttgaacaagctgtgattgccgcggccgtaaacatcttatttgatcagccgtacgtgattccgaaacgtccggcggatcagaaaaaagcagatatcgatcctgcgatttacagcagatttaccggcaattactcatttcaggatgacacacatgcatcggtgacggtaaaagaaaaccgattgtatcttgcaatagacgggcagacaccattcgaattattcccaatgacggaaacccgttattttgtcagggcgctgccgcttgaaattgaatttacaggtgataaagcacaaactgccccgcatttcgttttatatcaggacggcacagaagaaacggctttgcggatagactgactgacatgcaaaacaaaaccgccgtcctgagaagacggcggtaatagaaaagtcaaacccctttaatgacgcgaaattttcttttcggctctgacataaatatagaagaaaaaatcatagctccgaccattgtgatgtattccatataaagcgaaacttctgccaaaaccaaccccgcaatcattaaaacagcgcccaataccaccgcaaaaaccttcgttttcatgatgagttccccctattatctgataattaaattatactgcatctctattaatgtgtacattttgtgaacaatttcacctgataaaaggcaataaagagagagttgaagaattaggagaaatgacaggccatctttttgttttaccgaagaaacgaaagggaaaatgaaaaatcaaaaaggcaaaggagttcttgaaatgaaagcgagactatttttattcagcatgtttctcctgatccccgttctggcgcttgccggatgcaacggtcaatcttcaggaggaagcgaaaaagcgaaagacaaagaaacgcactctcacgaagacatgaatcactcaggttcatccgaggtgccgaaaggtttaaagaaagccgaaaatccgacttataaagtcggcagtgacgtcatgattttagcttctcatatgaaaggcatgaaaaatgcgcaaggaaccgtaaaaggtgcttatgatacaacggtttacagtgtatcttacactccggaaacgggaggaaagcgcgtcgaagatcacaaatgggtcattcaggaagagctgaagggcgccggtgataaaacgttaaaaccgggtgacaaggccgtgatcgaggcatcccatatgaaaggcatgaagggtgccgaagccgttattgattcagccaaaaagacaaccgtttatatggtcgactatacaccgactgacggcggccaaaaagtaaccaatcataaatgggtgacagaagacgagcttgctgccgcaaaataaaaagaccgccaaagccgaaggaactcctttggcttttttgcggtctcacatttatgcggattttcttttcaaggcaggtctcgttaaagagaatacagctaacgcgacagcgataatgacaatcaaaccgccgcaccaggctgttgctgtgacagaaccggtttgtccgatcacgccgccgccgatggctgacccgagcgcgatgccgatctgcaaagcggacgtgttgaagctttgctgaatatcggaagactcaggcgcaattttgattaaatagctttgctgcgccggcgcaaggctccagctgagcaatccccagatcaccatcgcaggcaggaaaatgattaaagaaaccgttgtcagcggaagaataaacaggatcagagcgaaagaaacggtcacaagcatgatgcttttaaatgctcctaaacggtcatacagccagcctccgaacgggccgccgcataccgctgacagaccgaacaaaaagtagcatacactgacccaaacggaactcaaatgaagcgttctttccaaaaaaggcgcaaagtaggcatagagtgtgtaatgccccgccaatgtaaacaaggtgacaaggtgtgcgctggcaattttggcggtcccgatcgtcttgatctgctcacgaaacggaatcattttttcagcaggtattttttcgaaaaagacgctgataatcagcatggaaatgagagataatacgccgattcccaagaacagaacacgccatccgaaggcattgctgatgataatgccgacaggcacgcctaaagcgattgcggagctgaaccccatgaaaatgatgccgatcgcccgcgctctgtattcaggcgccacgattttaggagcaatcgttaaagaaaggacgacaatcagccctgtgctcatggaagcgagcacccgtgacaccataagaacggcgaaattgggactgaaataagcgaccagattacttaggaagaaaataaacagtgcgattaaataaagccgctttcgttcagcctttgccgtcactgccaaaagcagcgggccggataccgcgtaaccgagcgcaaacacgctgatcagctgccccgcgctgacaatggatatatctaagtcggaagcgatttgcggaagaataccgcccacaattaattcaaccaatccgactgcgatggtagatgctgcaagcagaaatactttgaaattcatgtacagatactcctttttttattttttagaaaataaaaaatcctgattacaaaaagtgtacgggacaatttttgtaatcaggattttacggttcctggtagacaccctcaaaccatatcattgaggttatacaatatattgcaatattcggttgtgtccgtttctgcaaaaaattctaccataatagtgagggagattccatagaaaattcgaggaaatcctttcaatttcaatatcggcggctgtaacgtcattgatgaagcagggaaaaaaatttatgataaccgtaaggagtctatacagatcaaacattacacagccggaggaaaccgatgaataagtacgaaaaaatcgccaacgaaatgagaaagaggattaaaagcagtgtatatgacatagatcagccgatcccggatgaaaagacgctcgctgcggagttcgggtgcagccggatgacgatgaagcgggcgcttgatacacttgcggctgaagggatgcttttcagaaaaagagggcacggcacatttatcattcaatcagccatgcaggatgagcacgttcacgtagtcagcaacgaaattctcggcttgagcaatttgttaaaaggcaaaaatatcaagagcaaggtcatccggtttgaagtgcagtttccgtctcaagatgtcgccgcacatttggctatcgatgaaaagactcccgtctattatgtagtgaggctcagaatcgttgaaggcgaaccgtacgttcttgaaaaaacgtacatgccggcgagccttatacccggcattaatgacgaggtgctcaaccattccatctacgatcatattacgcggggattgcagctcaaaatcgcgggcacacacagaaaaatcagagcgtgcaagtcggatgatatggatcagcaatatctcggctgccggccggatgacccgatacttgaagtcgagcatgtaggctttttggacaacggcactccctttgaatattcattttcccgccaccgtcatgacaagtttgtcgtgacctcagtcaatataaaacgttcataaaagcgccgaagagtgagagaaaaactcactctttttttgttgccgctgatttacatcgtcgcttcttttatgttatattacccaatgatagaatcatcctacaaatttcagaggtgttttgatggagatatccaaaacaagcagactgtcgctcgtagaacaagtggtggcgcaaattgaatcgttaattcaatcggataaatggccggtcgggacgcgcattccccctgagctggatttaatgaagcaatttgatgtgagccgaaacacgttgcgtgaggccattcgggcgctcgtacatgccggcctgcttcagacaaggcaggggagcggtacgtatgtcagctcatccagtgttctcggcgcggcattttaccgccatattaaaaaatcaaatttgcttgaaacattagaagtcagatacgcactcgaaagagaagctgcacgattggcggcggaaaggcgtaatgacgaagacctgaaagcactgaaggcatgcttggatgaatgtgaagcggccttgcaaaatgaagatcgaaaacggtatgccgaagccgacattaagctgcacaaaacaattgtacaggcggcccataacaatatgctttctgatctatacgagcatatgacggaggcgctttgtgcgtcagtccataacctgttggaaatcacccctgctatccggatccacacccagcttgccgccgcgattatcggacagaaaccggatcaggccatggaggccgtcaaccaatacatcacagtatttaaagatacaatacacatggaggatgaacatgaaaattaaagacgaacatcaagttctgcaagcaagtcagcgtaaaaaactgatattgctggtcatcggagtcatattgataggggccaacctcagagcgcctctgacatcggtcggaccgctcgtttcctcaattcgggacagcctcggcatgaccaatgcggctgccggcaccattacgacagtgccgcttttggcctttgcatgtctgtcgccgtttgttcctttattgtcccggcgcttcgggaccgagattgtcttactgtcatcattaattgtcctgacagccggaactctgctgcgctccatcgccggaatcggcactctctttttcggaacgatcctgttgggattgtcgatcgccgtatgcaacgtcctgctgccgagtctcattaaacataagtttcccggaaatttaggcatcatgaccggcgtctactcggtttctatgaatctgtgcggcgcgattgcatccggcatcagcgtgccgatcgcctcttcagcgggggtaggctggaaaggcgcgctcggctgctgggctatcctttcttttattgcgttcgtcatgtggattccgcaaatgcgaggacgcgaactgcccgtccgcacgactgggacaaacggagagaaaaaaaacagtctgatgcggtctccgctggcttggaaggtaacgatgttcatggggctgcaatcccttattttttacaccgtcatcgcttggctgccggaaattcttcagcagaatggactcagctcaagtaaggcgggatggatgctttcattaatgcaattctcagtcctgccgattacttttatcgtgccgatcgctgccgctaaaatgaaaaatcagcgcgcactcgccggactgacggctttatttttccttatcggcattgccggcgttcttttcggaagcccggctctcactccgctatgggtcattttgatcggaattgcgggaggctgtgcgttcagtctggcgatgatgttcttcagcctgcggacccggcatgttcatgaagccgcggcgctttccggcatggcccagtcattcggatacctgcttgctgcgttcgggccgcttgtattcggtttgctgcatgacatcacgcacggctggacggttccgttattcatgctgatcgcagtctctgttctgattttcattttcggagtcggagcgggaaaagcggaacagatcaaaacagcataaaaaaacaaagggcccgtttagggtcctttgttttttatttaaaaagctgtctcaggccgttacgttgtcagttttaagccgatgacaccgatgaggataagccccagagacaccaattgtgacagattgaatttttctttaaaccaaagtatgcccacggccgaaacgccgatgcttcccatgccggtccaagccgcatacgcgacacctgtgggaagaacctgcatcgctccggaaagacaaaagaatgaaagcataaagcctgttaccatgacaatcagcggccacttttttttaaaaccgtcaatatgtttcatggcaacggccgctacaacttcctccgctccggcaataaataacagcagccatgccattaatgttcaccccttgtttcagtttctttcgtaaataccttcattcctaaaatgccggacaacagcaaagccaaaaagaatatttgcccgattgaaaacgattcgcctaaaatgacgcccgttacatatgtgccgacggtgcctattccgacaaaaacggtatatgcggcagccatcggaatttttttataagagcggatcagcatcagaaagctgacggcaatcaaaaggaaaataccaatccaatcaaagagcgaatccgcatgcttcagggcggacgcccaaactacttctaacaatccggctatcaatacaagcagccaatacatgatacagtcacctcagttatgaatgaatgtcagtcatttttacggcggtcaaaaatgatcggtctccgccaatcatttctgcaaacttcttttgagaaagctgaatatttcttttttatatacttcgagatcgacatcctgttcacagccgatataaaaccgttcagccgcgttctcgacaacgttgataatcgttctggccgtccatctgacatgaatgccgctgatgacctcaccctgttcaatggccgtattgatcatgccttccagccaggaataataaggctgataaatggcttcccatttctccattgaatgatcgatggcaagaccggaataacagagaacgataatatctttatgaagccgggtgatgtgaaatgtctcatctaccaaaatgtccagcaacgtccaaaaatcttcagaaccgtccgttttcccttttattctgtccagcgtagtgtcgagcaggttttctgcaatcgcggatatcagtgcgtttttagaagaaaagtataagtaaaacgtaccttgggccgttccggcttttttgacgatttctgaaatggatgctttgtctaatcctttttcagaaatgacttcaatcgcggcttgcaggatcttttcgtattttcccgagctttgttttgccaatagaggggttcctccttttatgaatgactgtcattcattttatcgcatgttcgcttttttgtcatcccttaacataaaaataccggaaagaagaccatacttctttccggcattcgtcatttatcactgtcgatcatagccttcggcagacctgtatattttgcccagtaataaataccgagcgaaccgatggcgatcagaatcaggtcaagcggattgctgataatgcccaatccgtggccgaacgagccgagataggagaaaatcagcatcatgacataaaagccgacgatccaccatgctgatttcagctgctggcgtatgctgacatcatctttgggagcatatttactgaaacagagatagatcagaaacatgacaatttgagaaccgagaagccaggatacggtgcgccatccggaccaatatacaatataagaggtaaaaataaacgacagcggcccgatgatgctcatcccttttaaataaaacggtctgttaatgttcttcgcgttgactctcagcgccgcagaagaaatcggcgcaatcgcataagacagaatcaatgcgacggagcatacgttaacaagagcgttccaagaagggaacggaagcgtccaaaaaacagccagaccgaacgaaagccaaagggaggcacgcggtgtcccggtttctttgttgactttagaaaaaatgctgaataatgttccgtttctggcccaggcatagacgagacgtgaagtcgtattcataaagatatttccgttaccgcccggtgataaaatcgcatctaaaatgaccaatgtcgccagccaccccaaaccgagcaagacggcgatatctttgaacggaagggagaattcagtcccgatagccggccatccgtgcttcagggtatcccccgggatcgccccgataaaagtgagctgcagcacggtgtaaataatagtagaaacgataatacaaacaatcaatgcaatcggaatgttccgcttcggattctgcacttcactcgcgacagccacaatcggatgcagcccaaggtatgcaaacatgacgccgcctgtggaaatcgcggcctgaattccggtgaaaccaaaaggcgcgaatccgtgaacggtcatattgcccgggtgaaaatgaaaaatcagtacaacaattaccgtaatcggtacgacatatttaaaaatcgaaataatgaagtttgctttcgcaaaggttttgacactccagtaattgaggaggaagaacaggcagagcagcgcaaattgcaatatccatccggcaattgtcggagaatcagagccttttacggtcaaaccgggaaaccaatacgccacgtattggcggactgccgtgacttctatagaaataagactcgtgtatgccacaatggtgacaaaggaaattaaatatccgaccaggtgtccgtgtgaatatacgggataccggataattcccccggtccgcggcagcgcggctcccagttccgcataaaccaagccgatcaataagatgattcccccgccgatcagccaggaaaaaacgcctgacgggcccgctttagaggcgacgttactgacggcaaacagccatgccgaaccgaatatggctcccatgccgattaaaataagatcaaaaagtgacatagttttctggaagtttccttgcttagacattcgctgcctccttaaaaaagacattgttctctttacataattcccattatcattcaaacatacccagccggccggctggaaaattaggacaactttcgaaacgaagtatgtacagatatgtgctcacatcaaaatcacggccgtatggcaagatctcccggcttatattccccgttttgaacacattcaaacctcatattcagaaaaacaaaaaacgccgaaacaggcgtttttacaagttcatatctttcagtccggggctgtgctcattcggaagctcgggaagttccgggacggggaaacctttaggaggctctgacacacttaattcgccgccgtttcggctcggcgtcgttccctgcagaatttctccgatccgtgtcggatccagtctgaaattaaattgggtattatgataacccatttcaacgaatttccggcattccgggtatttttcaatatcataattcggcacgggaaataatttgccccattcgacacccagtgtttccagcgcttttgtaaatgcattttgatgggcgttgtcacggacgatcagaaaaccgagtgtttctctgaacgtctggtttgagctcatttcataaatgcgcgtcttttgcagcacgccggttgattccaacacgacattgtccaatagatcggaaatcagattcccgtggttgtatacccaagacccgttccatggattgccgcttgcatcggcaggaagagaactttgcgccccgataatataatggtgcggattggcgtgtttaaccgcttcgtcaagcggcgcctgatctgctgcctgatttccggcgccctcagcgccgctttcatccagcagcgcattaatcgtatgctggacgagctcaacgtgtgcaatttcttctaaaaatacgccgcgaagcaggtcgcggaactgtttttcttttcctctgaaattagagctttggaaaaagtattgcatcatcgtccgcatttccccgtaatgcccgcctaaaatttcctgaagcaccttggccgcggccgggtccggcttgtccggtttaatgatattgatcagctcttctttgtaataatacataaacagcgccccctgaaagaagttttcggttcttctgttagtgtctttgcaaagtcagtttttatgtatcggcatcaaaaaaaggacggaaagcgtgtccgtccttttgtgttaagcctcaaccgcaccgcgaagtttcgtgttgacaagcccgttccatccttgatccatcgtactgtgaatctcggagcttttccgattgactttattgatgacggcttccggctctttccatccgccgtgaatgagagtgaattccgtatctccgctttccgtttcctttaagacaaaagagacgatccagccttccgtatcccacgaaaaagaaaggcggtacggcgcttcaatatccagcagcttgcacggagacggaccgaacggagattccagctgaaactcactgtcttcttgaggtgtgaaatcattcggcataaaccagagagacaggccgtccgccgtagagaccgtatcccagacaacttgtatcggcgccttgaaaacggcggtatgaataatgtccggtaatggctgattgctgttgttgtttttgttatctttgttttgtttatcagacatgatgcgtaaccactctttcgctgtttttacttttgatcatactacacagggcaggacatttgaaaacaaatcaaacttattttatgcttttccaaagccattcaattcattttaaggagacgtagtgatgacagatcaatttaaagcgttagtagtcgatcaacatggagaccggttttcagtcagcgtacgggagctggcggttcaggaccttcccgagggtgaagtgctgattaaggtttgctactcaggggtgaattataaagacagcttggctgccattcctgacggcaagatcgtaacctcgtatcctttcgtgccgggaattgatttagcgggaatcgtcgtttcttcagatgacgcccgttttaaagaaggggacaaagtcattgcgacaagctacggcataggcgtttcccattttggcggctatagcgggatggcccgcattccggcagattggatcgtgccgctgcctgaaggtctgacacttaaagaagccatgacgatcggaaccgccggcttcactgccgcattgtccgtccagcgtcttgaagaaaaccatgccgctcctgaaaaagggaaggtgctggtgacgggagcgacagggggcgtcggaagctttgccgtctccattctttcaaccttaggttatgaggtcgaggccagtacgggaaaagaagaagaaagcgggtatttgaagagcctcggagcaaagacggtcattcaccgcgacgaagtgtataacggcacgttaaaaccaatgcaaaaacaaaaatgggcagcggccgtcgatccggtcggaggtgagccgcttgcttcagttctcagtcagatccagtacggcggatcagttgctgtgagcggactgacagcgggaacgaaactcccggctacagtctttccgtttatattgcgcggcgtcagtctcttgggaattgattccgtattctgtccgatggagacaagaaagaaaacatggcagcgtttagctgatgacttcaagcctgcagatctggaggcctttattcaaaaggaaattacacttgaagagctgccggagacgcttcctgcccttttaaaaggagaagcgagagggagaacgattgttacaataaacgaagaataaaacaaaaacccccaatcagcagttgggggttttcaatatgtaatcaattattgattataataggggtaatttattgagtatatcatggaaataaattgatataaaacgaaaattgattatatataggtaatataaaggtgagttataaaattttatgaaatatttattgactgaaagcgcttttaaaattatgataataacataagtgccaataatatcattataacttcactacaaagtaactataaaataacaatatgacgagagggggagagcgaataatcactataaacgataacgctttcggaacattttcttcttatataactgttttggacggtcagaacttgtatgcagacgttagaggtgtaaatgttgataactgaatattctgatattatctctgtgtaaaaactaggaggatttgaagatgaataaaaatagcagccagcattcatttttgagaaccatcattttagtatcgacattcggggggcttcttttcggctacgataccggtgtgattaatggggcgctgccgtttatggcggaagctgaccagcttaatcttaccgctttgactgaaggggtggtggcgagttccctgctcttgggggctgcgatcggcgcggttttcggagggagattgtcggactgtaacggcagacgtaaaaatatccttatccttgccgttttgttctttgtagcgacgcttggatgtacactggcgcctaacgtatcggttatgatcatctcccgttttctgctggggcttgccgtcgggggagcatccgtaaccgttccggcatatttggctgaaatgtcgccggcggaaagccgagggagaatggttacccaaaatgaattgatgattgtaacgggccagctgcttgccttcacgtgtaatgctatcatcggcaatgtgcttggtgatacctctcacgcttggcgttatatgctcgttatcgcggcccttccggcggtattcttgtttttcggtatgctgaaagttcctgaaagtccgcgctggctggtttctaaaggaagaaaagaagatgctttgcacgttctccggcgaataaggaatgaagagaaagcgaagtctgagctcgctgagattgaatctgcctttcataaggaagctcagatggagcaggcgacctttaaggatcttgccgttccgtgggtgcgccgcattgtgtttatcgggatcggaattgcggtagtgcagcagctcaccggtgtgaattcaattatgtattatggaactcaaattttaaaagatgccggtttcgagacaaaagccgcattaatcggcaatatcgctaatggtgtgatttcagtgctcgcgacttttgtgggaatatggcttctcggcaaagtcggccgccgcccgatgctgatgacgggactgatcggaacgactgcggtgctgcttttgatcggagttctgtctgtcgtgctgaaaggatcgcctgctcttccttatgtggttctttcattaacagtcactttccttgcgtttcagcagggggctgtctctccggtgacctggctgatgctgtcggagatattcccgctgcgattgcgggggcttggtatgggggtgactgtcttctgcctctggatcgtgaacttcattgttggtttaacttttccggtcatgctcgcaaacatcggattgtctgcaaccttcttcatttttgtcctgttagggatagcgtccgttatatttgtgaaaaggttccttccggaaacgaaaggtctttcgctcgaacagcttgaacaaaacttccgtacctatgaaaaaacagatcgtaatagcgcagaagccgaggtgagcgggtaatctgaatagacgcggggttcctgggaatcctgctttttatttattatatagaagggaataataagcgggaaaaaagtttcgtaaaagtgttgacctaatttaaagtgcgtggtatattattaaacgtcgctgatgaacaaagcgataacgacaaatgagaaaatgatctttttaaaaaagactttacaaattctcgaaagcgtgtataataaatgaggtcgagaaaaaagacttcgaaaagaaataaaataatacttgacatcataactgattggtagtatgatagttaagtcgcctgataagcgcccgtagctcaattggatagagcgtttgactacggatcaaaaggttaggggttcgactcctctcgggcgcgccaattcaaatgcgggtgtagtttagtggtaaaacctcagccttccaagctgatgtcgtgagttcgattctcatcacccgctccattataatgatctttgaaaactaaacaagacaaaacgtacctgttaattcaaagttttaaataaatcgcacagcgatgtgcgtagtcagtcaaactaaggtctgcacgatgcagatcacacagacgttactgcaggatgcagtgaacttagtctgtgatccattgccggtctagctcaattggtagagcaactgacttgtaatcagtaggttgggggttcaagtcctctggccggcactctaaatgatggaggggtagcgaagtggctaaacgcggcggactgtaaatccgctccctcagggttcggcagttcgaatctgcccccctccaccattttataaataggggcatagtttaacggtagaacagaggtctccaaaacctccggtgtgggttcgattcctactgcccctgccactatattatttattcatcttcagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagttgcatttttttgaaaacaacagcataagatgtattaagttcttttacatgttgcggaagtagttcagtggtagaacatcaccttgccaaggtgggggtcgcgggttcgaatcccgtcttccgctccaaattacggcggcatagccaagtggtaaggcagaggtctgcaaaacctttatccccggttcgaatccgggtgtcgcctttctattgccggggtggtggaattggcagacacacaggacttaaaatcctgcggtaggtgactaccgtgccggttcaagtccggccctcggcaccaatttaactttgagcgaattatgttaaattggtcatcaattttcttattataaaacatatatgagagtgatttgcatattgcaggtcgctttttttatataataaaagcgtgaagactatcaatataagtttcttgcttgtatcgtatatactgcattaccatttgaaaaaactttactaaaaccattgactctttatagaatgcatgttatatttatatacgtcggttgaacacgacgcattatatgccggtgtggcggaattggcagacgcgcacgactcaaaatcgtgttccttctggagtgccggttcgaccccggccaccggtatacaaaggcttctacatattgtagaagccttttttgttgtataaaaatatctccaaggcttgtgaaaacatgatacctgcagcaggaggagctgaaaaggaaacaccgattcggccgtggagttaaatcattccgatcgggattaacactgtttctcagctggtggggcggccattcaaaagcgcgcattattagcagcggttattgcagtatttgctctttttatgtttcagcgctttcctgcaggcgagcttgttacccattttattaagggcggaaacgaattgatcaatgttattattatgttatcgctgatttgggccgtaacagcagtagctgaaaatctgggattatcgaaatatgttacttttcatttaatcatggatccctcatatgtttattgcgctgtctctttttatactgggggctgttatatctcattttatcggttcattctgggggacttggggcgctcggcgtaacgctggcggttcaattacataccagcttattattagcgagcggaacatttggtttgcttctcccctcagtgataatacggtgttggggatcgatgttgtgaagtatgcccgttcgaagcttgttccggcgattaacgccggggggatctccgttgtgttatacggtgcgtatttttcagataacaaatacttattgaaggcgttatccgaaattgggataacgcctttttaatgagctgttatacttgagaaaaaagaggtgatgacattgaagcagattattgcaatgggcggcggggggttttccatggagccggatcatcttgtgctggatcagtatattttagagcagtcggcgcggtcaaagccgaaagtttgttttttgccgacggcaagcggagattcggagaaatataccggcaggttttatcaggcctttcaaaagctgcggtgtgagccggatcacttatcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatcttagcgggtctcagcgccggagcgatttgctggtatgaagaaggggtgacggattcagcgggggatttgcgagagttaacagctttaggatttttgccgggcagcttttgtccgcactatgacggagaacggagcgccggccggtgtatcaccgtctgatttctgaaaagaaactcagggagggctatgccgctgatgacggcgctgcgcttcattataaagacggtcagctgttccgggctgtctcatcccgggaaaccgcaaagggttatcgggtttttaataccgaagaaggcgttcgggaaacagagcttatgaccattccgttatctgaattttgataatatgcttttttttgtacacaacttatgttacgatgagagcgaaatcaatagttactgggggtgcccgtctgagcgggctgagagagaagcggcggcttcttaaccctttggacctgatctggttcgtaccagcgtggggaagtaaaggttttattattgttgaggaaaacaataatagtttctttctgactgcaaaatcgggttcttctttgaacccggtttttttgtgctggtgctgagcttggttctgttattcaaatgataaaggagagatttgtatgcaaaatcaatcagtacagcaagcgaacatttccattatgtcgagtttttccggcagtaaaaaggtttatgcagaaggttcttcgcccgacatacgagtgccgatgcgggaaatcagcctgagtgcgactacgggggcattcggggaagaggagaatgcgccggtccgtgtttatgatacgagcggaccgtatacagacccggatgtacagattgatattcatgaaggtctgggggcgctccgcacaaagtggattaccgggcgcggagatgtagaagaatataacggccggaccgtgagacctgaagacaacggctataaaaaagaagatcatgctgccgaataccccggcctgcagcggaaaccgcttcgggccaagccggggaaaaatgtaacacaattgcattatgcgagaaaaggcatcattacgccggaaatggagtttatcgcaattcgcgagcatgtgtctcccgaatttgtcagagacgaggtagccagcggccgggcgattattccttctaacgtcaaccacccggaaagcgagccgatgattatcggccggaattttcatgtgaaaattaatgccaatatcggcaactcggctgttacatcttctatcgaagaagaagtcgaaaaaatgacgtgggcgattcgctggggcgccgatacgatgatggatttatccacgggaaaagacattcatacgacgcgtgaatggattatccgcaactgccccgtgcctgtggggacggtgccgatttatcaggcgcttgaaaaagttaatggcattgccgaggatttaacgtgggacatttatcgtgacacattgattgagcaggcggagcagggcgtggattatttcaccatccatgccggcgtactgcttcgttacgtcccgttaacggctaaacgcacgacgggaatcgtatcccgcggcggggcgattatggcgcaatggtgcctggctcatcatcaggaaagctttctgtacacgcattttgaagaaatttgtgaaatcatgaagagctatgatatcgctttttcacttggtgacgggcttcgtccgggttcgattgcggatgccaatgatgaagcgcagtttgcggaattggagactctcggagaattgacggagattgcgtggaagcacgatgtgcaagtgatgatcgaaggaccgggtcatgtgccgatgcataaaattaaggaaaacatggacaagcagctggaaatttgtaaagaggcgcctttttacacgctcggcccattaacgacggatatcgctccgggctatgaccacattacttcagcaatcggcgcggcgatgatcggctggtacgggacggcgatgctttgctatgtcacgccgaaggagcatttggggctgccgaatcgtgatgatgtaagagaaggcgtcattacgtacaaaatcgcggcacatgccgcagacctggctaaagggcatccgggtgcacagatccgtgacgatgctctgtctaaggcgcggtttgaattccggtggcgtgatcaatttcatttgtcgcttgatcctgaaagagcaatggaatatcatgatgaaacgctgccggctgaaggcgcaaaaacggctcacttctgttcgatgtgcggcccgaagttctgcagcatgagaatttctcaggatattcgtgattatgcgaaggaaaacggacttactgaagacgaggccgtcaatgaagggctgaaagaaaaagcaaaagagtttgcagagaagggaagccgcttatatcaataaaagaaaagatgaagatggagtgtatccatcttcatcttttttagaaaaacggtgaacggcgaagcggcggaatgctctgctcgaagcggaatatattttccggatcatatttcgttttgacttgacggaggcggtgaacattttctccgtaatacgtttgcagccagtttctgatttctctatcaggccaattcacataatctcccatcgtttctcttgatagggacgttctcagtccttcgatccagcggacattttgtctttcttcttcagcagatgtccaagttgtaatatattcttgggcaatgattgcgttgcgatagtagaatgccgtttggtccggagcgatccgtccggccgccccgccgagagattgctgccagacactggcgttttcgttcggagcgtgctctaaatagcgctttaaagtggatattgcgcgtgttgataatggtttttcaataaaggatcctgaccgcttcatcttttgcggctgattgcctcccgggctgttaaaaaaggctgccgctttaataaatggcactgtcttgaccaagccgcttgtcggttttcccgctttcattaacggagccagcagttctttcagctcctcttttgtcccggtaaattgaccgagcgattctatgcggttgacttccttaggccaaaactgaattgatgaggtaagccggttgtctgtaaatggagcccagcgctgccacgtattaaatacttcctcgaaatcatcccagccccaagtgacagaaaaaacagacacgcacgagatcggcacggctttaaacatcatggatgtgacaatgccgaagttgcctccccctccgccctgagatgcccaaaatagatcagagtgctttgagcggttgactgtgatcaagtcagcacccgctttttcgtccgctatgatcatttcgagctggaggagacgatcgcaagtaagtccggcagtccttgttaaatatccgattcctcccccgagcgtcagccccgtgattcccacattcgcaatggttcccgcaggaagggtcaagccgtaccgccagagtgtccggtagacttcccctaattcggctcccgcttcaatcgagaccagccgcttatcctcatttactcttattttcttcatttcactgagatcaatgactagtccgtcatttaacagggaaaaattttcgtagctgtgtcttccgcctctgatacggaaaggcacattgttctcacgtgcccatctcaccgcattgagggcgtcatgtttgttttggcaaaacactatgatgtctggatatctttgcaggcttaaattgaaattggttcttgcggcattatagtccgggtcatcttttttgacgatgcgaccgctcaatgttgtcttttccacattctcactcactttcacttgtaatctgctatgtttcctagcatatgcggaaaaatgagagagtgtatgaggaaaacccccggaaggacacgatattttaaattatagttgacaggtagggattgtatgaattaacataatcattacatatttccaaacgatggctgatcggatcaccgaaggctcttatctattaaacagataagggccttttttgcgtgaaagtcattaaatgaaaagcggagggatgaaaagtggcgttaaaaaaggtatcacatgtgcgcaaaaagagcaaaaagcggaaaaagtacagaaaacacacattgaatttcgaactgcttgtagagaaaaacaaacgggagattatgagaaatgaggaacagatggagcagatttatataaagatagatgaaaagcatgcgggggttcgataaagatgaaggagagaaaatggaggttgaaaacaacggtactcgcgctgtcggtatccatcatgttatcagggtgcgcgttagggagtgccggggaagaaccgtcatctgcggctgataaaaaggaagaaacacgtatcacccatgtcaagacaaaggaatttaaagcttctcatccggcggcgattcccgctaaatcgaaagccagaactgacacttttgttgctgggatttccgcgccgggcggcgtgtttctgccgtatttttacgaaaacggctgggatggaaatgcgacagatcctatttttgaaccgttagtcaaactggataaaacggggaagcctgccccggctcttgcggaaagctggaaaatttccaaagatcagcttacatacacgttccgtttaagaaaaaatctcgttttcagcgacggttcaccgctgaccgcaaaggatgccgcattcactttaacactgctgcatgatcctgcatacgcgggctatgaagatatcaccacggcttatattaaaggcggtaaggcttacaaagaaggaaaggcaaagacgatagagggcattcgcgtccttgatgacagaaccattcaaatcacgactgagaaagtcagtgcgaagtcgctgcttcttttgggcgggcaggtgctgtcagaagcctactacgggaagaaatatcaattcggcaaactggactatttaaaagagctttatgccaaaccgctcggagcgggaccttatcaatttacagaataccttccgggacaggaaatacgctatcaggctaatgaacactattatgccggaaaaccgaaaacggaaaagctgatttataaaattatcgatccgtcaacttcccttcagctgtttgaaacgggtgaccttgattacgcttctttctcacctgatgatgatacggttcagcatttaaaaagtctcggttttgcgaatataagcgtatctgtcgtgaatgattacgggcttgtgtacgtcaatcacaagcgtccgccttttcaagataagaaagtgtcccaggcgcttatttacggacttgaccgtcaaaaaatcgtcgatgtccgctttaaacgctacggagaggtcgcgaatgttccggtgtctccggtttcgtgggcttatgatgacaaaggtgtcaatcggtatgcgtttaaccctgaaaaagccaaaaagcttcttgatgaagcaggctggaaaacgggcaaagacggtgtacgtgaaaaaaacggcaaaaagcttgaaatcagctattacacatctaaagcggatgatgatttcatcccgatagcgaaagaaaattatgcggacatcggaatctcattaaaaccggaagtgatggattttaatacagaagtagcgaaaatcaatgacaaacaatatgaccttgccgccgtttccacctcgcagatccttgatccgaatgacacggtggaaaagctggcttccggccatcccaataatgtgacggggtattccaatccgaaagcggaccggctgatagagaaaggagccggcacgcttgatatcagcaaaagaaaagaaatttatcaccagctgtaccgggagctcggggaaaacccgccttacattctgattcattaccgtcagagcgcaagggcggtcagcggaaaaataaaagggcttgagcctgacaattattctggaatcagttcaagtctctcaaatgtctcaattcaatagaacggttgggcaaaatacccgatgcatcctggggattttgccctttcagcggaaaggaggggctttttatgaaaaggtatgccgcagaacgattcattcaaatgcttgtgatcttattcggtacgtcctttattatttttttcttattcgccatgctgccgggcgactatattgattccaatgtaaacctgactccggaaagagcgaaggagttaaaagcgctttacgggctggatcagccgatttggcagcgttatgtgacatggctcggaaatgtgctcagcggagattttgggttttctttgaaatatcaggagaacgtcctgtcactgcttcggaaatatgtctggaattcgttttttgtcgcgtttttggcgttgcttgtcacatggtcagccgcgatgataacgggtgtcatatccgctgtcaggaaatactcatggtttgacgggatcgtgacgtttcttgtttttgcttccatggcgtttccgtctttttttatcagccttctgtttattaagtggtttggggtggatttgaaaatattccccgtcggcgggatgattgataccggcagcacgagtacaggtttttcgtatgtgcttgaagccgccagacatatgattcttccggtcgtgattttatctatgctcggcatcggctcgctgacaaggtatttccgctccggcatgctggacgtgatcagacaggattatatcagaacggcgagagcgaagggattgaaagagcgcaccgtcatctggaaacatgcgttgaaaaacgcgctcattccggccatcaccctgcttgcttttgaactgccgggactgttttccggagccatcattattgaacagattttcgggtggccgggtgtcggacgtattcagcttgaatctgtgcattatcgtgattatccggttttgatggcgtttaccttgtttttgtcttgtttaacgattgtagggaacttcttggcggatatcgcttatgccgcggttgatccgcgggtcagactgaaatagggggtgttcggaatgaaaaaacaaaaagaggtgccgccttctctttggaagcagacgtaccgccgcctgctgcagcataagctgacggtcatcagtcttcttttcttatgttttatgtttttattgtgctttatcgggccgtctttttctccgtacataacagatcggacggatatttcaaatgccaatcagcatccgggaatccatcactggctgggcaccgaccagtacgggagagatgtgctgacgaggctgatgctggcggggcagatttctctgaccgtggggcttgcttcaatggtgctgtcgcttgtcatcggctctttactcggggctgcggccgggttttatcggggagccgctgatatgatcattatgcgcattgctgatatgctcatgtccatcccgggcctgccgctgcttttgattttggctgcggtgatgtcggagtggaaagtgccttctgaatacagaatgtacctgattatgatgatgttaagcctgatcggatggcccggtttggcgcggcttgtacgcggacagattttgtcgctgaaggagcagccgtttatgatggccgcggaagttttggggcttagtgataaacggaaaatcctctatcatttgcttcccaacacattgccgttattactggtagcggcgactttgcatgtggcgggagcgatgctgagtgaatctgcgctgagttttctcgggcttggcgttgctccgccgacaccttcttggggaaacatgatggaagcggcgaatcattttatggattttacactccgcccgtggctgtggattccgccgggaacggccatttttctgaccgttgtggcgattcatctgcttggagacggtttaagagacgcttttgatcctaaggtaaaacggcaggtgaaaatgaaatgaaaaaaccgcttttagaagtaaggcatttggaaacggctttttatacagaggagggtgcggtaaaggccgtggacggagtcagctttacgatacatgaggaggaaacggtttgtattgtaggagagtccggctgcgggaaaagtatggcgtcattgtccattatgcagcttattcccgagacggggagaatcgaacggggagcggtgcatttttccggacagaacctgttggaactgaaaccaaaagacatgcagaaaatccgcggaagcgaaatcgggatgatttttcaggaaccgatgacatctttgaatccggtatttacaatcggtgagcagctgaccgaaccgattcgcgaacatttgttgctgagtaagaaagaggcatggcgaaaggccgttgaactgatcacgttagtggagatcccgaatgccgagcaggttatgaaccgatatcctcatgagctgagcggcggcatgctgcagcgcatcatgacggctgtcgcgctaagctgcgatccgaaactgatcattgccgacgagccgacgacagcgcttgacgtaaccattcaggcgcagatattggatttattgcgggatatgaaaaagcaatttcgcacgtctattttattcattactcatgaccttggcgtggttgctgaaatggctgattatgtgattgtcatgtatgcgggaaaaattgtggaggaaggaccggttgcagagctgttttctgatccgaagcatccgtatacgaaagggctgctcgcggccaagccggttatcggtcaaaaaagggagacgctttacaccattccggggcaggtccccgagcttgcggacctgtcgggatcgtcttgttattttgcggagcgatgtgaacacagcacggaaatatgccggagatcgagcccgcattttactgaattcgggaaggggcatcaggcggcgtgctggctttacagagaggagaaagcagatgagtgatgtgttgctggaggtcaaggggctgaaaaaatattacgaggagcatggggggatgagaaagactcataaaaaacccgtaaaagcggttgacggtgtcagttttacgataggaaagggagaagtgttcggcttagcgggagaatcgggcagcggaaagtcatcaatcggcaagaccattttgaggcttcatgagaaaacagggggagaggtgttttttcaggggcgtgatgtgtttcggatgagccggcgcgagctcaaaactttcagatcggaagcgcagctcatctttcaagatccgttcagttctttaaatccccggcgccggattggagaagccatcggtgaagcgatgatcgagcatcaattggcggtgaagcggaacgcgcgtgataaagcggcggaagttcttgaagcctgcggactttccgcaaactttatcgaccgatatccgcatgaattttccggagggcagcggcagcggatcgtaattgcaagagcgatggcgctcaagccgcaatttatcattatggatgaacccgtggcggcgttagatgtctccatccaggcgcagatgatcaatttgttcagcagccttcaaaaacagcacgggctgtcatatttgttcatttctcatgatttaagcgtggtggagcacttatgtacgaaggtcgccattatgtatttagggacgattgtggaatatgcgtcaaaggaggagctcttttcacggccgcttcacccttatacgaaagcgctgttatcagccgtgcctgttcctgatcccggatcgaaaagggagcggataattttaaagggtgatataccgagcccctctgatccgccttcaggctgtaaattccgaacgagatgtccggaagccaagaagatatgtgctgagaaaagtccggcgctgtcagaaaaagggcttcatcattttgcggcatgccacttcgtgtaattgagaaaaaaacggttttattgataataaacaggaaaaacctgccgggcagaccggcaggttttttgatgttattttggtgacggcagtccgagtccttcggcaacgcgtctgccgtattcaggatcagccttgtagaagtggccgatctggcgcagcttaatttcttctttttccacaggtttcatcgcactgacgatattggcgacaaggcgcgcgcgttcttcctcgctcatcaggcggtacaggtcgccggcttgtgtgtaatgatcatgatgattatagcttacactgtcagcgaaacctgatacaggatatgccgcctgtttatcttcaggtgactctttcgggcccccgaagctgttaggctcgtaatagacggagcggccgccgttatcatcaaaacgcatttgtccgtcacgctgatagtttttcacttcattgcgggaacggttgatcggcagcgcctgatggttcgggccgacacggtagcgatgcgcgtcatggtatgcgaacaaccggccttgaagcattttgtcaggtgagacgtcgacgccgggcactaatgtgccgggagagaacgtcgcctgttctacttccgcaaagtaattttccggattgcggttcagaactatgcggccgacttcgatcagcggatagtctttttgagaccacacttttgtgacgtcaaacggatcaaagcgatatgtgtttgcatcttctaacggcatgatttgaacatataatttccatgcggggaaatcgccgttttcaatcgcattgaacaaatcttccgtatggtaatcgggattttcgccggcgatttttgcggctgtattaacatcaaggtttttcacgccttgctctgttttaaagtgatatttaatccagacgccttcgcctttatcatttgtccatttaaatgtatggcttccgaatccgtgcatatgtcgaagagtcgccggaatgccccggtctgacatcagaatggttacctggtgcagggattcgggtgacaaagaccagaaatcccaaacggccgtcggatttttcagatgtgttctcggatctcttttttgtgtatggataaagtcagggaacttgatggcatcgcggatgaagaacacgggtgtattgtttccgacgatgtcgtagtttccttcttctgtataaaatttaacggcaaatccgcgcgggtcgcgcactgtgtcactagagcccagttcgcccgcaacggttgagaaacggatgaaaagcggcgtgcgtttaccgacttctgacagaaatgcggctttcgtatattttgtaacgtcatttgtgacttcaaaataaccgtgtgcgcccgcgccttttgcgtgaacgacacgctccggaacgcgttctctgttaaagtgcgccaatttctcaagcagatggacgtcttgtattaaagcaggaccgcgatcgccggccgtcattgagttttggttatctccgacaggagcgccccagctggttgtcaatttatttgaactcatgtgatcacctctttaaatttataagaacataatatcacctatcagtaaaaagtcaatattattttataatgattataaaataattatttttattatcgaaatgaaggtatgggtttaaaaacccacttgactgacgggaataatgggtttaatatgagaaaaaatagaaaccgctgacttggacacaagaggctcttattcttcactggataagggcctttttttattgtcaggcggtaagggaggcggcgattgtatgcttttcaggcagcattttaaaccagtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcgggtggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcggacattattgaaaatcgcccggcaagaaaaggaagtaaatacgtgatacagccgatgcgctctttggcaggtttatgccggaaggcgcatttttaattcatacaaaaaacagttgacaagtcggaataatttgaattaacatgatattcaaatttaaaaacaaacgggttgccgatcggaccgccgaaggctcccatctctgcaagcaatcggagatgggagcctttttgtttttcgatcgcatgcggcagaaagagaggggaagacagatggctgtaaccatcagcatacaagaaaaagcttttgagcatgaaggccggaaaacgccggtgctgaatgatattgagctgtcaattgcatcgggagaatttttgacggtcatcgggccgagcggatgcggcaaaagcacgcttttaaaattgattgccggtcttgataccgattataaaggctctgtcgcaataaacggccgcaatgtgtcgggaccgggcatccggcagggatttatctttcaggagcaccggctgtttccctggctgacggtaaaacaaaacatcgctgccgatctcaatatgaacgacccggccgttcggaaaaaagtggatgatctgattgaggttgtcaggctgcagggagcggagaacgcttatccgcgcgaattatccggcggcatgtcgcagcgggttgccatcgccagagcccttttgcgtgagccggaggtgctgcttttagatgaaccgttcggggcgcttgacgcttttacgagaaaacatttgcaggatgtgctgcttgatatatggcgcgagaaaaaaacgacgatgattcttgtcacgcatgatattgatgaatccgtctatttaggcgataagctggcgatcctcagggcaaagcccggccggctgcacagcctgatgccgattcagcttccgcatccgcgcaatcggacgtcagcggattttcaggccgtccggcagaaggtgctttctgaatttgagaaaacggaagacctccggtttgcggatgggtccggaatatagaagggacgaagcgaagtgaaaaaaatcatcattcttttagctgcagcagtcatgatgtcagccggatgcagtgccgacgggacaggagggagcggggaaacggtgaaagaaatccggatcggcatccagcagagtttaagcccgcttctcattgccaaggaaaaaggctggtttgaagaggccttcaaaaaagacggaataaaagtaaaatgggtcgaattccaaagcggtcctccgcaatttgaaggtcttgccgccgataagcttgatttttcccaggtcggcaattcaccggtcatttccggtcaggcggcgggaattgattttaaagagatcgggctgtctcaggacgggttaaaggcaaacggcattctcgtaaacaagggcagcgggattcagagcctgaaagaattgaaaggtaaaaaaatcgccgtagccaaaggcagcagcggctttgattttctctataaagctttagataaagcggggctttccgccgatgacgtcactatcatccagcttcagcctgatgaggcggtttccgcttttgaaaacaaatcagttgacgcatggtccatttgggagccgtatttgtcgattgaaacgctgcagcacggggcggaaatattggcgaacggagaaagcacagatttatattctcccggtttcacattagtcagaacgggattttccaaagaacacccggatgaggttgtccgttttctgaaagtgttcaataaagcagttacatggcaaaaggaacacaaagataaagccgtctccttatatgcgaaaatcaaacatcttgatccgaaagtcgtcagaaacgtgcttaacaatactgagcctctcaatgaaccgatcgatgatgatattgtcaaagcccagcaggaaaccgctgattttcaatatcgaacaaaagcgattcataagaaaattcatgtaaaagacgttgtcgacaattcatttattaaaaaagcgcttgaaacgggggatggcaagtaatgaaagcagaagcatcaacggctgccggcgcaataagccaatcagaaaagaaagctctggcaagatcccggaagtattcataccaatgggtgaaggggggtgtactcccggctgcggtcatcgcagtatggcagtttatcgcaagtctgggcatcgtctcggccgcggtgctcccgtcgcctgtcgtcatcttgcagacgtttcaggaacttcttctttcaggtgagctttggggtcatttagagatcagtttataccgggcggctgccggatttctgcttggcgcgggcctcggacttgttttcgggctgctggtcggtttctcaaagcggacggaagcatatcttgatccgtctctgcaaatgctcaggacggttccgcacttggccgtgactcctctgttcattttgtggttcggatttgatgagacatctaaaattctgctgatcgcattgggagcttttttccccgtgtatattaatacgtttctcggactccgcagtgtggacgcgaagctgtttgacgtcgcgcgggtgctggaatttaattggtatcagcagatgacgaaattaattcttccggcatctctgccgaatatcctgctcggcatcaggctctctctaggcattgcgtggctcggtctcgtggtggcggaactgatgggatcgagcgagggcgtcggttatatgattatggatgccagacaattttcacagacaaataaggtgtttgtcggcattatcatttttgcggctgtcggcaagctgacagatgcattggtcagaatgctcgaacggaaactattaaaatggcggaacagttatgaagggtaacctattaaaaaaggagagattcatatggagattctttggtttattccgacgcatggtgacggccggtatttagggacgcaaacgggagggagaacggcggatcatctttattttaagcaagtggcacaggcggcggacagactcgggtatacgggggttctgctgccgacggggagatcatgtgaagacccgtggctgacggctgccgctttagcgggggaaacgagtgacttgaaatttttagtggcggtccgtccgggactgatgcagccgtctgtcgccgcgagaatggcgtcgacaatggaccggctgtcagacggccgtttgctcgtaaatgtcgtagcgggcggagatccttatgaactggcgggagacggtatgtttatcagccacgatgaacgttataaggcgactgaagaatttttaaccgtctggcgcggactcatgcggggcgaaacggtgacatatgaaggggaccatatcaaagtggaaaacagcaacctcctgtttccgccaaaacagtctccgcatccgccattatatttcggcggttcatcacaagcgggaattgaggctgctgcgaaacaaacagatgtctatttaacatggggagagccgccggagcaggtaaaagaaaagattgaaaccgttaaaaaacaggctgcgaaggaaggaaggacgatgcgttttggcatcagacttcacgtgattgtcagggagactgaggaagaggcatgggaagcggctgaacgattaatcagccatttagacgaagagacaattgcgaaagcgcaggctgcgctccggcgcgctgattcatcgggacaaaaacggatggccgatcttcataacggtgaccgctcgaagcttgagatcagcccgaatctctgggccggcatcggactggtcagaggcggagcgggcacggcgcttgtcggtgatccgcagactgtcgctgatcgaattttagagtatcaggcactcggcattgagtcgtttatcttttcaggctatccgcatctggaagaagcttattatctggctgaactcgtgtttccgcttctgccgtttcagaatgagcggactaaaaagcttgagcgcagattgggtgaagcaatgggaaacgaccattttgcaagaggaaataaagcgacagtctgatgacgtcgcaaggcggatcattgatggcgggtgctttctgcggtttcatttccggggaaatgccggcagtgaaggcgggtattcacccgcctttttaagcgcttagcttgcacgatgctcatatggatgatatgatacaaaacgtaattattacgatttgttaggagtgctgaaatggcaaaaaaatcaaaagtaatcaaagagctcaagcggcagaagcttgttgaacaatatgcggacatccgaagagaattaaaggcaaaaggcgactgggaagcgctgagcaaactgccgcgtgattctgctccggccaggcttcataaccgctgtacggtgacggggcggccccgcggatatatgagaaaatttaaactgtccagaatcgcattcagggagctggcccataaaggccggattcccggggtgaaaaaagcgagctggtaatgtaaaaaactccggatctgtcatgaaccggagtttttgccgtgcttatgaaaagtgaaaacataagccaaatgctgaatcatcatcagaataaaaatcaaaagaatcggaaaaaaaggaagatgcggctgaatcagcggataaaacaaaagcagaacggctgcggccggcaatgaaaagtaaacggcgatatacgaggaacggcaagctttagccgtcatcattcgttctctttcatcctgttcctcaaattcatcggggactagcctatgctttttgccgtttcgttttttcttttcggcatagatatacaatgcggcacaaacggtaaacagcagaaacggagtgatattcagctcaaatgcaccgctcccctccgtttggaaaaactgagcgatccgcggcgccgcttccataaaggaaataagcgtccagcaggccaatccgtagagtgcaaggtgaaaacacgcttttcttttcaaactcattttttctcctcctccagccagaaaacttcctccatcggcagtgagaaagcccggcagatgttaagcgccaataagagtgaaggcacataatctcctttttcaatcgctgcaatcgtctgtctggtggctccggcttcttttccgagcgtttcctgagaatagccgaatctggctctcagctcttttactttatttttcatcatcagggcgtacctcaagttttcttcttttttatattgtatgagattcttaacaaaatgtaaacctaacttaacatgtggacaaaaaaagaatttttttcgacaaattttttaacattcccttgacgaaaaaaaaatatacatgtaatattagaaacatcaaatcggtactgacaaaaactttgatgcgggtgtagtttagtggtaaaacctcagccttccaagctgatgtcgtgagttcgattctcatcacccgctccatacatacgttattaacgcagtgtttcgtttctttgataaacgaagtattgcgtttttttatgtaaaaaaagacacgaaggcgtgtctttttatgaaagccaagagacggtatgtgtgcctccgtgaatttgttcaaacattttggttaaggatgatagcagctcatccgccgcgtcggcatgaaatgaaggcgggaaaaagatcagctgcagcattttctttgtgccggttgttacagggcgggtattgatatgtccggtaaggccgccgaaaatgccgccagagtcggaaaaagcaagtacgtgttctttttctccgattgtaatcgaaatcggttcatctatttctgcggcgtcatacgccatgataggcaatgaatatttcaaggagaaaaaaagtatggtatcatgggctgaattcacactttcaatgaatcgttcccgggaaatatcgccgagcataagctccatcggcgttttttgtcctgaaaaggcgggtctgagctgttccattatacgcgcccactctttaacaaaaggctgctcatctataccgccgtcagcataatcaaagtaaagagattcttgaaataaacggaggcggcctttcagcatttgcggagcaggcccgacttcgatctgttcatataagacggctgccgctttgatccccggcacccgttcagcaataagtggatctaaactgatgttcaagtgtgttcactccatttcgggatgataaaactctattatacccgtgcgggagcctgatcacaaagaaaggaggctgtgcaaaaaatgaatattcataaactgaaagaggaattaatcgaatacgccaaaagcatcggagttgacaaaatcgggtttacaacggctgatacgttcgacagtctgcgggaccggctaattcttcaggaatcactcggctatttatccggttttgaagagccggatattgaaaaacgggttactccgtctttgcttctcccgaaagccaaatcaatcgtcgccatcgcccttgcttatccttccaaaatgaaagatgcgccgaggagcacgagggacgggcggcgcggcattttttgcagagcttcctgggggaaggattatcatgatgtgctgcgggaaaagcttgatctgctggagaattttctccaaagcaaacatgaggatatccgcacaaagtcaatggtggatacaggagaattgtctgacagggccgttgctgaacgtgcgggaatcggcttcagcgccaaaaactgcatgatcacaacgcctgaatacggttcttacgtctatctggctgaaatgatcaccaatctgccctttgaaccggatgtgccgattgaagatatgtgcggtacgtgcacaaaatgtctagacgcgtgtccgaccggcgctctcgtcaatcccggacagcttaacgcccagcgctgtatttcgttcctgacccagacaaagggatttttgccggatgagttccgcacgaaaatcggaaaccgtctgtatggctgtgacacgtgccagacggtctgtccgattaataaggggaaagattttcatcttcatccgcagatggagcctgatccggaaatcgcaaagccgctgttaaagccgcttttgaccataagcaaccgcgaattcaaagaaaaattcggacatgtatcgggatcatggcgcggcaagaagccgatacagcggaatgcgattttagctttggctcattttaaagatgcctcgtctcttccggaattaacggccttgatgcaccaagatccgcgccccgtcatcaggggtacggccgcctgggccatcgggaaaatcggtgatcctgattatgcggaggaattagaaaaagcgcttcaaaaggagcaggatgaggacgccatacgggaaattgaaaagggactggagctgttatcggtttctgagaagactaaaaccggccggtcctgacatatgtatagagaaaaagcacttggccggagttcaagtgttttttctttataaaatcgtatggtgggtggagcgcttgaagcatattattgaagatttagcggaggcccggcttcattatttaattaacggaactgagatgaggcagaatgggcaggccggcgatcttgaggtcctgacgagaaaaaaagagctgtttgaaaaacggaaagttgatatcgtgaaagcgaaggcaaaggccgtcattgtcaaaagcagtcttgaggacgacggcacgttatgtgtcatgtacacgattcatttcgaatatttgtgcaaggagcatgacggacacctttacttagaagagcagattgaggaacggactgcatttctctatgatgagcttttgattaaagaccgggaagtaaagaaaaaaccggctggattttctgacggaaacagcgtaattgaatatgagcggagtgaacgggaagatctcgggcgggcgtttcaatacgaccgtctggctgccgtgcagtacgcggagaagttttggaataaacgaaaccccgcttataaaaatttcagcgataattgcaccaattttatttcccaatgtttacatgccggaaaagcaccgatgcgggggcatccgaacagaggctcaggctggtggatgaaggcaagctcgtggagttacagctggacggtcgcgcattcgatgaagatgtatctggcccaatccaaggcaggacttcgcgcggtgcaagtatcaagagctgaagaactgatgcccggagatatcatttgctatgattttgaaggagacggccgttttaatcatacggcgatcgtggtcgcaaaagataaaagcaatatgccgctcgtcaatgcccaaacgtatgacagcaggatgagatattggtcatatgaggattcaacggcgtatactccttccatcagatatgcgttttttcatattacggatgatacgacaaaagagtaattaatgatataatggtgggcggaataaaaaacagaggtgaacatcgtggcattacatgtcgttttatatcaacctgaaatcccggccaatacgggaaatatcgcacgtacttgtgcggcaacagacacaacgcttcatttgatccgcccgctcggattctcaaccgatgataaaatgctgaagcgcgccggactcgattattgggagttcgtcaacgtcgtatatcatgattcattggaagagttatttgaagcatatgagaacggaaagtttttcttcattacaaaattcggtcaaaagccgcacacatcatttgattactcaaatacggaggaagactttttcttcgtattcggcagagaaacgagcggacttccgaaagaattgatcgaaaacaatatggaccgctgcctgcgtctgccgatgaccgagcatgtgagatcattaaatctgtccaacacggccgcgattcttgtatatgaagcgctgcgccagcaaaattacagagatttgacgtgagaaaaaacgcccgcatccgggcgtttttttattgaataaaaaagacaggcagcagcggtttacggcatttttatatttccaggcttaacaacgtaacagtgttatgttacaatacgttcatcgaaggagctggattcatggaggaacaactgatttctaaaaaagaattgctggaagaaacatcaatttcatacgggcagctgtaccggtggaaacggaaaaatttaattcctgaagaatggtttatccgaaaatcgacgtttacaggccaggaaacattttttccgagagcggaaatattaaaacgcatctcaaaaatacaggaaatgaaagaaaatctgtctctggatgaaatgagagaaatgctgtctccgcaaatgactgatgtcaatataacgtctgcggaactgcttcaaaagggactgatttcaaaagccgcgctgcaagtttatggcgaagacggcgtgacattcacgtcccgcgcgctgctgtctttatatgtgcttgaagggcttttgcaatcgggcaatatcagccttgaggaaggaaaattggcggcgggggtgctgaagacgtatgaggcttccgagctgaaagcgaatacggagcttgtcatgctccgaaagctcggcgtaacgacgtgcttcatcgcagacgcggaacatattttatttgaaccgactgtcaaagtggttgaacgggtggcgcttgctgcggcatcggaagaattaaaagcgaaatggatgcaggaggaccatcaatggaagtaacagataaattaatcattaacggttcgggaagttcaaaaggaggccgttttcatacagtggagatcaacgggagcggcacggtgtcgggtgatgtggagtgcacgagccttttgtttaacggcagcggaaaaacagacggacatgtcaagacgcaaacgctgacaatcagcggttcggggaaaatctccggcagtgccgaagctgaatccatccgtatcaacggaacgggtgtcattaaaggtgatgtcaaaacggagcggctgaacgttgcgggattttcgtctttcggcggcggtgtgaaagctgatgatattttcatatccgggaaagccgggattgaaggtgattgcgagacagagacgttccgttcggaaggcaaatgcaagatcggcggcctgctgaatgccgatgaagtcagtatgaagctggcggcgggagaaagccatgtgaaagaaatcggctgccgccatttgaaagtgatgagcagaaagagcgtgcttacgcgttttaagctgatgccggccccggtgctgacagcagagctgattgagggtgacatcattgaattggcggacacgaacgcgaagacagtccgcggaaatcatgtgcggatcggcgcgggctgcaccattgggacggtggaatacagcggcgattttacatgtgatcctaccgctttggttaacaaagtcgtgaaacgataggaggagctgcaatggaaacgacaaaaaaattgagtcatttaaaaatgtacggagccggacacgcttccggcggttcctaccaaaatgtaagcattaaaggggaaggaactgtcggcgaaggacttcaaagcgaacgctgccggatattcggcacgggactttttctcggagatgccgagatcaacaggctgaaaattttcggagagcatgaagttgcaggagatttatcagcacattcagcaaatgtgatcggcacattgaaaattggcggctccatgcgtttcgccaggatgaggctgaaaggacttgctgaaattggcggcggggccgcgggggaacagtgtcatataaaaggcagtctcaccgtcggcggcgattgcgagacggagctgcttcatgtaacaggatgtatcaatgtggcgggattgttaaacgcaggggacgtaaacatccatttgcgttatgaccgaagccgcgtgaaagaaatcggcggcacatcgatcaccgtcagacggaaacccggttttcttaaacggaaagccggcatgctttctgctgaattgatcgaaggagacgcaatttacctcgaatacacggaagcggacatcgtcagagggaagcgtgtggaaatcggcccgggctgcaaaatcggaaaaatcgagtatcaaacaagctgtaagtctcatgaaaaatcaactgtccaagaacatattcaaatatgaaacattgttatgttgtacaggaaagggtgctcttcataaagagcacccttttgccgttatttgttttcaggtttgctgtcgtaacccgcagtaaaaatggatactaaaaaagtgagaatgaccccaagtaaaatgatcgttttcatcatgtctcctcctctttgcttttccatttgatgtccgagtctggatgaaactgtatttctttcattatgaacggtgcaccggacccttgtcaatgacggccttataacgtctttatttttaagaaacgaaaagcatgtattatcacgtcaccgcatagattgtaacaaagtaccttatttctagtgcattaaccatgatagaggaggttcttatggatatattaaagaaaattgaaaagtacagagaggaagagcagcgtctcaaatgggaagggacgttcgctgattatttggagatcataaaagaaaatccattggtcgcgcagtctgctcattctcgcgtttttaatatgataaaagacagcggaatcgaggaggatgacgggaaaaagacatacagctttttctcgcgggagctgttcggccttgaggaatctctggaacggctcgtggaggaatactttcacccggctgccaagcggctcgatgtgagaaaacggattttactattgatgggacccgtcagcggcggaaagtcaactcttgtcaccatgctgaaaaaagggcttgaagcctactcattgacagataacggcgctgtttacgccattaaaggctgcccgatgcatgaagatcctctccatctcattccccatcatctgcgcgacgacttctacagagaatacggcatcagaattgagggcagcctttctccgcttaatgtcatgcggcttgaagaagaatacggcggcagaattgaggatgttaaagttgaacgtatattcttctcggaggataaacgtaccggaatcggaaccttcagcccgtctgacccgaaatcacaggatatcgccgatttgacggggagcattgatttttcgacgattgccgaatacggttcggaatcagatccgcgcgcttatcggtttgacggtgaattaaataaagcgaaccgcggaatgatggaatttcaggaaatgctgaaatgcgatgaaaaatttctgtggcaccttctgtcactcacgcaggaagggaatttcaaagccggacggtttgcgctcatctcagccgacgaattggttgttgcgcatacgaacgaaacggagtaccgctcgtttattgccaataagaaaaacgaagcccttcactccaggatcatcgtgatgcctgttccttataatttaaaggtgtcagaggaagaacggatttatgaaaaaatgatttctgaaagtgatgtttctgacgtacacatcgccccccatacattaaaagtggctgcgatgttttctattttgacccggctgaaggaaccgaaccgctctgatattgatctcgtcaaaaaaatgaggctctatgacggagaaagcgttgaaggttacaattccgttgatctggaggatatgaagaaggaattccatgatgaaggaatgagcggaattgacccgcgctatgtcatcaaccgcatttcctcaacgattatcagaaaaaatatggaatccatcaattcgcttgacgtgctgcgttccttaaaagaaggactcgaccagcatccgtccatctccgccgaggacaaagagcggtatatgaattttatttccgccgccaggaaagagtacgatgacatcgccaaaaaggaagtgcagaaggcgttcgtttattcatatgaagaatccgcgaaaactctcatggacaattatttagataatgtggaagcatactgcaataaaaataagcttcgcgatccgctgacgggtgaagaaatgaatcctgacgaaaaactgatgagatccattgaagagcagatcggcatttcagaaaacgccaaaaaagcgttccgcgaagaaatcttaatccgcatatccgcctatgcaagaaaaggaaaacgctttgactataattcgcacgaaagactccgcgaagcgattcagaaaaagctgttcgcagacttaaaagatgtagtgaaaattacgacctccaccaaaacgccggatgaacagcagcttaaaaaggtcaatgaggtagtggcaaggttaatagatgaacacggctataattcgactagcgctaatgaactgctgaagtatgtcggaagcttgttaaaccgctgatatttgatttcattgagaggcccgtctgtaaaaggacgggttcttttgtctgtttttcgcaattgtttgtcaattggagagtccggccggcataagataaaaataaatcttttcgccggacttgtttcataaacaggaccaagccggaatacacatgtaaaacgaccataacggttaaggaggggaattcatgtcccgtaatgacagcggaaattttttgatttcagaggaagactggtccctccatcgcaaaggctttgacgaccagcagcgccaccaaaagaaagtgcaggaagcgataaaaaacaaccttccggaccttgtcactgaggaaagcattattatgtccaacggaaaagatgttgtgaaaatcccgattcgttcgcttgatgaatataaaatccgttataactatgataaaaataaacatgtcggccaaggcgacggcgacagcgaagtcggcgatgtcgtcgcaagagacggcgcagataaaaagcagggcgccggaaaaggccagggagcaggcgatcaggcaggcgaggattattatgaagcggaagtttcattgatggatctggaagaagcgctgtttcaggaattagaactgccgaatctgcagcaaaaggaaagggacaatatcgtccataccgatatcgagttcaatgatatccggaaaaccgggctgacagggaatatcgataagaaaaggacgatgctgtcggcctataaacgaaacgccatgacaggcaagccgtcgttttaccctatttatccggaagatctgaaatacaaaacatggaatgatgtgacgaagccggaatcgaaagctgtcgttttagccatgatggatacaagcggttcgatgggcgtatgggaaaagtatatggcgaggagcttctttttttggatgacacgatttttacggacaaagtatgaaacggttgatatcgaatttatcgcccaccatacggaagcgaaggttgtgtcggaagaagattttttctcgaaaggcgagagcggaggcaccatctgttcctccgtttaccggaagtctcttgaattaattgatgaaaaatatgaccccgcccgctacaacatctatccgtttcatttttcagacggggataacctgacttcggataacgcccggtgcgtaaagctcgtcaatgacatcatgaaaaaatcgaatctgttctgttacggtgaggtcaatcaatataacaggcattccactctcatgtccgcctataaaaatgtcaaagatgataaatttaaatactacatcctgaaacagaaatcggacgtatttcaagcgctgaaaagcttttttaaaaatgaggaagccggtataagcaaagcatcgtattaaatataaagccgagtgaagaatcgtgcggccgcggttcttcatccggcttttttaaattaaaaataaagagaaaaaacggcataaaaaaaatccttaaaaaatgaaacttttctctttacaaaccttctttcatttattaatattttatcttgtgaactattattaagggaatgaggtgaaaatacggtgattgaatcagagctcgctttgctcagttttgaacaactgtttgatacttccagatcgatttacaaaaagcagaaaatgattctggagacagtgcttgaaccttttgatattacagtgctgcagtatctgctgatgttcaaaatacataagagcaaaagcacgcagctttcaaggctggctttgtcgcttgatctgaaaccggcgtctgtcacgagaatgaccgatattctgtataagcgccgcctaatggttcggagcgactatcacgacgaccggcgtgttgttatgattcagttaaccgaagagggggaagaacttctaaagaaagctgctgttcaatatgccgaaaaagcggcggtcttataccggcagctcaataccgctgaactgcagtacctgcgcaagcttgcggaaagtttaacgaagcttgcaaacggatgtgcagtgaaaaacggaaaataaaaaaatccccacatatttttatcatcattccacaaaatgatagaggaagaaacgaaaggagaaaacaaaatgaacagaggacgtttaattctgaccaacattatcggtttgattgttgttcttgcaattataggcggaggtgcttactactattatcaaagcacacactatgtaaaaaccgatgaagcgaaagttgccggcgacatggctgctatcacagctcctgctgcgggtaaagtaactgactggaaccttgatgaggggaaagaagtaagcaaaaacgacgttgttgcaaaaattaaaggacagcaaaatgctgacgtaaaagccatcatggatggaacaatcgtgaaaaacgaagtgaaaaacggccaaatggtgcaagccggtacgacaattgcccaggaaattgacatgaaacacctttacatcactgcaaacattaaagaaacagacattagagacattgaagtaggaaacaaagtagacgtaattgttgacggcgatcctaatacaacatttgacggaacagtagaagaaatcggttatgcgacaaattcaacatttgatatgctgccttcttcaaactcaagcggcaactacactaaagtaacgcaaaaagttcctgttaaaatttcactcagcaacccatctgacaaggtgcttcctggtatgaacgcatctgtaaaaatctctgaataatacagatcagtcatcaaaccatgaagggaggttgtcttaggtggctaaatcagataatcaagtaaaaagtcctaaaacattgcttattgtgcttatggccgggttattcctggcgatcttgaaccaaacgcttcttaacgtggcgatgccgcacttaatgaccgagttcggtgtgagtgcgacgacgattcagtggcttacgaccggatacatgctggtcaacggtgttttgattccgttatctgcgttcttaatcacccggttcggacagagaagcctctttctcgtagccatgttctgttttacagcgggaacgttagtctgcggaatcgcgcctaacttctcaaccatgctgatcggccggttaattcaggcggtcggcggcggtatcctgcagccgctggtcatgacaaccattctgcttattttcccgcctgaaagcagggggaaaggaatggggattttcggtcttgcgatgatgtttgctccggcggtcggaccgactctatccggctggatcatcgagcattacacatggcgcattatgttctacggccttgttccgatcggggcaatcgttattatcatagcgtttttcctctttaagaacttggtggaaccgcaaaaaatcaaactcgacagcttgggtgcgattctatctattgtcggattcgcctcattgctttacggagtcagtgaagcgggcagcgacggctggggagatccgatcgtgctgtctaccgtcattgtcggtgtcatcgcgattgccgcgtttgtcattcagcaattgcgctctgaaaaaccgatgcttgacttccgggtatttaaatatgatattttctcactttccagtgtcattaatatcattattaccgttgcgctttacacaggaatgttcctgcttccgatttacctgcagaacttagtcggctttacggcgctgcaatcgggtctcttgctattgccgggcgcgattgtcatgctgatcatgtcgccgatttccggtattctgtttgacaaaatcggtccgagaccgcttgcgattatcgggctggtcatcacggtcgcaacgacattccagtacacaaaattgacaattgacacaccttacacgcacatcatgcttgtctatgccatccgcgcattcggtatgtcactgttaatgatgcctgttatgacagccggaatgaaccagcttccggcacggttgaacagccacggcacggcgatgagcaacacgctccgccagatcagcggatcaatcggaacaagtttgatcacaacgatttatacgaaccgtacgacaatgcattattcgcagattgcggataaaacaagcacggctgatccaagcttcatgcagtcgttccaaagcgcggtttcgaatttaatggtcaacatgaacatgtcgcttgatgcggcgaaacaaaccgtttattcatatctctacaaaacagcttcacttaattccaacgttatggggattaatgacgcgtttatgtgggcgacgatctttgcggttatcggcgtagtcctgagcctgttcttgcgtgacgtgcggaaagacaaacagcgggcgaagaaaaaagaggagctgtcattgcttccggcccctaaagaagtgaaggaatcttaatcatctgaatgggaggtttcctgaatgaaaatttacgtagtgtacgatagtgaaggcgaacacacaaaacatcttgctgaagccattgccgaaggcgcacgagaaaacgctgaggctgaagtcctgatcgaccatgtcgatcaagcagacatccgcaagctgaaagacatggatgccattatctggggatgcccgggtcactttggcaccatcagttcaggcttaaaagcgtggatcgacaggctcggctatctgtgggctgaaggcgagctgattgataaagtcggcgctgtattctgtacgacggcgacaacacacggcggattagaaatgaccatgcacaatctgatcactcctatgtttcaccaaggcatgattgttgtcggtcttcccggcaacgttcctgaaaacgcgctgtacggctcttactacggcgcgggcgtcacatgcccggttgacagcgatgtgctgatgacggaagaaggccttcaattaggccgtgcgcttggcagacgtgtcagccaggtcactggtaatctaactgccggacgacagtaaggagagggttatatggccattattatagcggttattgctgctgtcattgtgattgcacttcttatcacattcaatgtccgcagcacttctgcaggacaggatgtcaaagaagaaaagagagaagcgatcggcactacagccgaacagccggaaaagcatgatccggccgaggagcgctcagccgagcatgctcccgtcgttgtaaaatctgaatctccccgtgagaaaaagaatacaatgggcgatgatgtgtaccgtcaggcgcttcagaagtttaagacttctgagacggatcaggaaccaaacgatcctgatagcggcggcaaaatgcaggatagcagctatcgtgatgcgctgctctccttaaaaaacaaaaagaagtaattgaaaaggcaaatccgcgtaagagcggatttgtcttttttttattgaagatattgtaatacgtgatgatctagtgtactatgttactcatacacttgatccgaatggagagagaaagaatgacatcgtttttaggtttgctgaaaaaagatgcgaaagtttcatggatttggctcgcggtgtggctttgcggcatgatttgctgggcgtttgcagcccacgtcatcgctgcccgtcagaaagaaccgctcgtcattttcggcttttttacggcaatggggttttttcaatttcttgtagcgccgctttttatgtattatcaccttcataaagaaggaaaaaaccagctgtggctttacaatccgaatgggggattttatctgctggcttccaagctgacggcctcactgctgtatcagttgatcgggcagctggcgctgaccggttacggcatttggatgtaccggatgctttctgcaaaaggagtgctggaacacaccattcccctggccggcacattaaccgggctgaatgtttacctgctgatcagttcagcgtacttatctgtgatcgtggccgtattttggactgtttttcactcattaaaacattttcccgtcctgcgttgggtgatctgcatcgtgcttgcgtttgtctggacctatattgacgataaaatcattacgcctttcacttcatctcaacatgatttatggccggtaaaagtgtatgcgaattttcattttcattatacaaaattgaccggatggacgatggagctgaaagccgtccacatttcgcttttcagcttcctggcagtgatcgtgcttgcagcgctctgtctcgcgctggcctctatgctgctgaatcgaaaggttgaggtgtaatgatggagaatgaatttcagtcatccaagccgatttatctgcagattgccgatcgtatatattaccggctgatccgaagtgagctttcaccgggggacaaactgccgtccgtaagggagatggccgtacagatgaaagtgaatccgaacacgatacaaagaacgtacagtgaaatggaaaggctggggatcgtggagacgagaagaggacagggaacctttatagcggaaagatccgatctgaaagcagagctgaaagacaggctgacaaaagacgttttcaaacgctttattcaggaaatggcggagctggggttatctcctgaggaaatgctcgaggggatcaaacaatatgcggaggaagcaaacgatgaatcttgattttgaacgcgtaacaaaaaaatacggccgcaggatcgcggtcagcgatgtatcattttcattgtctccgggtaaaatctacggaattttagggccgaacggaagcggtaaatcaacaacgcttaaaatgcttgcagggcttgcttttccgacatcgggcgccgtccggatgggagagtgcaaagtaagcaggaacatgctgtttcgtacggcttatttaaccgaacatgatatgttttccgcccggacgaccgtcggtgatatgctcacgttttatcattcgcaattcccggattttcagctggaaaaagcacataacctattagcggaaatgaatctttcagcgaagcagaagttaaaagagctgtccaaaggcagccggggcaggctgaaaatcgttttggccctgtcgagaaaagcatcggtcattctgctggatgagccgttttcgggtcttgatccggcggtcagggagtcgattgtcaacagtctcgtatcttatattgattttgacagccagatcgtcgtcatcgccacgcatgagatcggcgagattgagacgctgttagacgaagtgatggttttcataaaagggaaaatcgctgaacggcgcgaggtcgaagaaattcgggaacaggaaggaatgtccgtgctgcaatggtatagaaacgtcatgcaggcgcacgaaatagaagggggattctaattggaaacggtattagaactgcaacaggtaaagaaaacgataaaaggacgaacgattattcatgatctgagcttctccgtccgggcgggcgaagtgtttggatttttagggccgaacggagcggggaaaaccactacgatcagaatgatggtcggattaatgaaactgtctcagggagacatcgtaatctgcggggaatccattacgaaaaactatgcaaaagcggtcaggcacgtcggagccatcgtggaaaacccggagctgtacaaattcctgagcggctataaaaatttacagcagtacgcaaggatggtaaaaggcgttacgaaagaaaaaatagatgaggtcatcgagctcgtcgggttgcaggacagaatacatgacaaagtaaaaacctactctctcggaatgagacagcgtctcggcctcgcccaaagcctgctgcataatcctaaggtgctgattctggatgagccgacaaacggcctcgatcccgccggcatcagagaaatcagggaccatctgaaaaagctgacacgtgaaaaaggaatggctgtcatcgtctcaagccatcttctgtcagaaatggagctaatgtgcgatcgaatcggcattctgcaaaaaggagagcttgtcgatattcaaaaagtaagggatgaaggaaaagaggataaagatacatacttcttccatattgaacaaagagaagaggctcttgccgttttgagtcagtttgactgtgtgaagaagacaaacggcattgagatccagctgtccaaacaggaagtgcctgatgtgatatcactgctcgtccgtgaaaacatccgcttatatgaagtgaaaatcatgacaaaatctttggaagaccgtttcttggaaattaccggcgggacgaaagaggaggttcaatatgtttaagctgatctataatgaatggattaaaattttcagccgcgtcggcacgtgggctatgattgtgattttaggcgtttcgatgatcggttttgcgcttctgtcaaaccatttcacctcgagcgaagccaatccgaattggaaacaggagctccaggctgaaaacaaagaaatgaaacagcagatgaaggaaaccggaaatcagacgctcattgataacctgaaacagaatgtcgcgataaatcaataccgtatggatcataacatccccgaggatacagggtacacagtgtggtcatacgtagctgattcttcgatgatgactgttttgaccgggctgtttacgattatcattgccgcaggcatcgtggcgaatgagttcaactgggggacgatcaagctgctggccatccgtccgctcagccgttttcagattttgctttctaaatatatgacagtgctgctgttcggactgctgatgcttgtgattttatttgccggctccgctctgttgggattggtctttttcggtacaggcggagatactgcggctgatgttcatctcgtatacaaagacggccatgtttttgagcaaaatatcatcgctttcctcgctaaaacatatgtctatgaatctgtctccgcttttatgcttgcgacgatggcgtttatgctgtctgcggtattccggaacagctcattagcggtcggattttctatttttctattggttatggggaacacggcgacggtatttcttgctgcgaaatttgaatggaccaaatatattttatttgcgaacacggatttgtcgcaatatatgaacgggactcctttagtagaggggatgacgatgacattttcggttgtgatgcttgtgatttacttcgttatttttctggcgcttgcattcggcgtcttcttaaaacgggatattgccacctgatataaaaaagctgttttgcctttgcaaaacagcttttcgttttagatgaaaaaaacctgccggcgtacaccggcaggtttttttaaacaatttatgcttttgttacgttagcagcttgtggtccgcggtttccttcaacgatttcgaaagaaacagattggccttcttctaaagttttgaagccttcgccttgaatagcagagaagtgaacgaatacatcgtcttgaccttctacttcgatgaatccgaatcctttttcagagttgaaccattttactttaccttctaacatgaaatttcctcctaaagcgacaaacgcttaaattcactattcttgctctaaaacaaacttccaagacgaaaactcttacaaaactttcttcttaaagatagttcgaacaaaaataattacctttactctaccagtaatccgaagaaaaaacaactgctaaatgtaacttttttcgaaataacatgttttaagaggaaaacgctctgatacggaaatctgatttgagaccagaacagcccatttgcagctgataaaaaccgctttgcagcctcttaaggaagcaattgacaaccctttttttaatcggtattgtatgtaatcatgagcccgaataccatggtgcagcttctgtacataaaaatagatagggagtaggtcaacttgaatctgcggcttataaacagtctgtttcttttcattttgatcatgtcacttacttcatgcaattatcctgacgggaaccggaccattactatcggaatcaatgaatctgatcaatcgatctgggagtttgtcgcgaaaaaagccggtgaggaaggattgcagctttctttggtaacgttttcggattatgctgaggccgatttggcacttgccggcggggatctcgacgccaatgcgtttcaatccgttactaattttaaatctttgccgcctcacgtgaaaaagaagctggctcctttaggaacgacatatgcggcatcgctgggggtgtattccaagcaacataaacggctgaaggatataccggacggagcggtcattgccgtgcctgatgaagcggcggccttcggcagggcgctttttctcatgcaggaggccggactgattacattgaaaaagggattcagcggtacggggtcaacggatatgatcaaggacaacccgaagcatctgaccttaaaaacggaaacaaaaaagaacgcctatcaggcggcggaacatgctgacgcagcagttctcagtcaaagcgaggcgaaaaaagcaggatttcatgcggagaaggacgcgctgatccgatcggcgcaaatgaaggaagcgtatattcatctgatcgccgtcagagctgaggataaagatgatgaacggacgcaaaaactcctgtctttgtatcaatcagatgataccgcggcgttgattgaaaaagaatatgagggcagcctgattcccgttttcctgaggggcggctttctcactgaaaagaaagaatgatttcctcttcgggcgatcattcttttttttcagtgctgcacacttgattgcgccctgatgttttcgctttgtacagcatccggtccgcgatcaggggcaatgtctgagggtccggtgtatttgtcggataatgcgcgatgccgagggaaacggtcacgggaattgtatctccgctcgtcagcagaatcgggttcgcgtcaatcgtgtgcctgatttcctctgcgaggtgaagcccttttgtatacgtgcaattgggcataagcacggcaaattcttccccgccgatgcgggctgacgtatgagaactgctgagtaagaacctcaggcgcgcccccagttccttcagcacttggtccccttcataatggccgtattgatcattgatctgcttaaagtgatcaatatccaaataaataagcgcgagctgagacgagggggattgagacgtccgatcgtacagaacgcgcgagacttcctcgaattttctcttattaaaaattcccgtcagaaaatcataattcgcttgaaacttgtattgcttgaacaaaacgcgggcatcggcttcgtgtttgatgatatacagtgacagcattccgcccaagatggaaatgagccaataataaacgagggccccggcaggctgttcaggcataagaaacagcagcgtcaaggtgaaaataacatttgaaaaaagcagcataacgaacgccattttatgatccggcttttttcctctgaggacggccgcagaaagtatcgcaataaccccgacggcggcgatggaaaaaatggcgcttgcattgaaattgatcaggatacggcctgcgacgataatcgcaaaggcggctgccgtagacacccagcctccgtaaagagcggcgatgataatggggatatttctgagatcaatgatggaatcggagtaagaaaagccgaaagcaatcagaaaaacccctaaaagcccgcagaccgtccccttcagtaattgaaacatcggacggtcttctttatacgaaagcgactctttaaaaagaagggtgaacagataattaaatgtgattaaaatcgttaaattaagaaacagttccttcagcataacaatcacccttatataagttactagagaaagggtggaaagaaaagagaaaaatcaattaaaatacatatattgtcaatccttacttgaccgatcggaattgatataatatagtgttaaaggataatgagcaagggagtgtttacctgttttggagaatttatttgtagtcttacatgtttttattatgcttttgcttatagcaggtctgtttgtcatgcaaaaaaaacacgtttccttttctaaacgtgtctttaccgcgctcggactaggcattgtattcggttttgcactgcaattgatttacgggccggcatcacatatcgtgacacaaacggccgattggtttaatatcgccggcggcggttatgtcaaattgcttcagatgatcgtcatgccgctagtctttatttctattctcggcgcatttacgaagctgaaactgacccataacatcgggaaaatcagcggactgatcatcggaattttgatcgccacgacagcaattgccgcggcagtcggaattgtttcggcgctttcttttgatctgaaagccgtccatatcgaccagggaagcaccgagttatcaagaggccaggagctgcagcaaaaatctgaggatatgacggccaaaacgctgcctcagcaaatcgttgagcttctgccgggaaatccgtttcttgatttcacgggagccagaccgacttccaccatcggagtcgttattttcgccgctttcctcggcatcgcttttctgggcgtgaaacggaagcagccggagcacgctgcgacgttcagcggaattgtcgatgcggtatacgcgattattatgcgtgtcgtgacgttaattttaagattgacgccttacggggtattggcgattatgacaaagacgatcgcgacaagcgacatcgacagcattgcgaaactggggatgtttgtgatcgcttcatacgccgcgcttatcgtcatgtttatcattcacctgctgctgattacgttcagcggtttaaatccgatcacatacgtgaaaaaagcatttcctgtcatggtgtttgcgtttacgtcccgttcaagcgcaggggctttgccgcttaatattaaaacgcaaaaaagcatgggcgtccctgaaggaattgcgaacttcgccggttcattcggtttatcgatcggtcaaaacggctgtgccggcatttacccggcgatgctcgcgatgatgattgcgccgacagtagggcaaaacccgtttgaaccgggatttatcatctccgtcatcgccatcgtggcaatcagttcattcggtgtagcaggcgtggggggcggcgcgacatttgcggctctgctcgtcctatccgctttgaacatgcctgtcgcgcttgccgggctgctcatttcaattgagccgttaattgacatggggcgtaccgccttaaatgtcagcggcagtatgaccgcagggctgttaacaagtaaaatgacgaaggaaaccgataccgcggtgtacaatgattcctcaatcgtcattgaagctgaagaagcttaataaaaaagcagatagcgctaaaacgaaaaatccttcatcgttgaacgaatgaaggatttttttcgtttctaatgatttccgggttcaatttcttccagcatattcatcacggtgctgtcatttaaaacatttaccgcgctttcttcgaagtgaatcggctcggtatagtgaggcttcggcgaagtttctttactgcggtctgcctgtccgtccgtatgggatgagccggagtgattgcgggaagtctgctcatgctgctgtccgccggattccccgccgaaagcctgtttgatcagctcggcaggctgcacggagcctgtttgtgaatgccgtggtttgtccgtgtgctgctgtccgccggattccccgccgaaagcctgtttgatcagctcggcaggctgcatggagcctgtttgtgaatgccgtggtttgtccgtgtgctgctgtccgccggattccccgctgaaagcctgttgaatcaggtcagcaggctgcatggagcgtgtaccatctttatgctgcattcggcctgaaaccattccggagattttccgacggatttcgggtgataaagctgcaatcagaatcgatgatccgatcagcagcgctgtcgggctgatgccgcttttttgtctgaacaagttaaatccctcctcattcaattgattacgcttacctttccctatccttctgatatttatccaaaccgctcagaatgcaaacggcgtgcataaatcccgccgaatagaaaaacctatacgtaaagtgagaaaggaggaattcacatgataaaaaaacaagcagttatttctgcccttcttctgccgatgctgattaccgcagggtgcagtatggggaaccagggagaaggaaaacgaaatgacaaccgcacccagaatgtaaattaccgcaacacacctaacgacggtgcgacaaatatgaatacagtgaaccgtcataaccaaaacaccgatcacaatgacaaccgtaacctgagagtggctgataaagccgccgacaaggtgactgatttaaaagaagttaaaaatgcgactgtgatcgttgccggaaacagcgcttatgtagccgttgttctgacaaacggacaaaaaggcgccatcgccaaccatttgaaaaataagattaccgataaggtgaaatcagccgataaacatgtccggactgtatatgtatcagcaaacccggacttcgttgaacgtatgcaaggctacggaaaacgaatccaaaacggccacccggtatccggactgtttgatgaattcggccaaatggtgcagcgtgtattcccaaaccccaataaatgaatggaaaagccgcatttgctgcggcttttttattttatctgccgtcacgacccagcgcttctgagcataaagtaaagaatgagatgaaaattaaaggatcggggaggggagcttgtttgcgtgacggcatggggaaacgggcggcattcactctgatcctgtgcggagtccttgtcatattggctgtcagttcagccgtttcagtaagtatgatgtacgtcctgtcaggccaaaacagccgctctgttccgacgaaggaacaagtgactgaacacatgaataaagaaatttacaaacatacagcgatttactatacggcggatgaaaagccgctcttggatctgaccaagcttacgctggaccacgcaaagcgtatcaaccaaatcattgtcggctataaaggagcggcgcctcttgaactcattttcttttcggatgaagctgaaatggagcaatactcaggattgaaaaatgtagtcggtttttattcagagcaggagcagatgatggggcttttgccagaagagaaaaaaaagcttttgaaaaaagatgagctggccgttttcatgtataagcaattgattatacatgaatatacacactacgcatttcatcaaaaaacacgccaattggggacggatacgtctgtatttccgctttggtttcatgaggggctgagcgagtgggttgcgcattatgatgtggtcattgatccgattgaattttccgtcgtgccgtttgatcaattaacgaccgaccgaaaatggcagaaatcgcgtatggaatatgaaacggatgtttatttgcaaagtttctatatgataaaggatttaaccgaaacattcggagaaggcattatcttaaccattatcaataaaaccgccgaaacacaggattttgaaaaaggctttgaagcggctacgaaagaaagcctgaaacaatttgaacatgatttcacaaaagcatatgaaaaaaagaaaacggcattggagagtcaggtttccaacgccgtttttttcattaatggaggttttgctgctgctgtcccatttgtcctttaatcggaggcatttgcggctgtccctgcgccggcgcaaatgaattcagcatggtctgcatatcttgtgcattgagctgaggaacctgataataaccgtgtttgttttggtataagaagatttcatacgccatttcgacatattgctgaatttgggcggagagcactcttcttgtgacaggattggtcatttcaagcgagctcatcgtcaagagagaagcttgagctttaatcaggccgagcatatggccgcttattccgagatctttgacatcatttaatgattgattcggttttttcggctgagtcggttttataccgtagacggcctggttctgttcctccatcatatatgtcgacgtttcctgagaaggcttttggccggtcttaaagcattctgccgtcagattatagagtccgagaatgaattgatactggcggtcaagaatgtcggccagctgctgatcctgtataaactgtctgagcatcataaattgatccaaaacgccgactgttccggccagcacttcatgcatatcgaaaagctcatgtcctccgtgattcacttgcggtgaacccggaatcccctgatttactggcggctgctgctgattctgctgctgttccactggttgttttcctccttcatgtcaaatcacatttaagatgtgaaaaaagccgatccgttatacatcaagacttatttcgttacgtggggattatttactattttgcgccagcgaagacaatctttacaaaaaagtgatgtgatttttaagaaaataagctaacgtatttcttagaagacagggggggggaatgaatgaagaaaaaaaggggtttgcgtctttcgtgctgtttgctgacggtttgttttatgatgttcagcgtgaaagatgcggaagcaatcggacaagccggatcactgaatgaagctggaacggataaagcgtataaagaacggcagactgaagactccggccgtatcccgctcagaatcatcagcatgaatgatctgcacggaaaaattgatcagcaatatgagcttgaccttaacggagacggtaaaccggatggcactttcggacggatggactacgccgccgcgtacattaaaaaggcgaaagccgagaaagaacgcgcctttgtcgtgcatacgggcgatatgatcgggggcagctctcccgtgtcagccctttttcaggatgaaccgacagtagaactgatggaagacatcggttttgatgtcggaactgtcggcaatcacgaattcgatgaaggaacgaatgagcttaaacggatcatcaatggaggagatcatccggacggtaaggggacaagcggttatgacggccaaaatttcccgctcgtctgcgccaactgtaaattgaagtcaggggagccctttctgccgccgtatgaaatcaaatacgtttccggaattccggtcgcatttatcggggttgtaaccagatcggcggcaggcatggtcatcccggacggaattaaaaatattacgtttacggatgaggtaaaggccgtcaatgacgccgccgcagacctgaagaaaaaaggaattaaagcaatcgccgtgctcgcccatatgtctgctgaacaaaatggctcagccatcacgggagaatccgcaaagcttgcaagcggaacagactcagagattgacgtgattttcgccgcgcacaatcataaagtcgtaaacggagaaatcaacggcaagctgatcgtgcaggcatttgaatacggaaaagcaatcggaatcgccgatctcgaactagataaagagtcgaaggatatcgtgaaaaaatcagcggaaatccaatatatcgatcaaagtaaaatcaagcctgatccggatgcggcaggcatattaagcaaatatgaagagaaagtgaaaccgattatcagcgaagcggtcggggaagcggcccatgatataacgggcgggtattcaaatgacggcgacacggcgctcggaaatctgattgccgacggtatgaaagcgaagatgaaatccgattttgcgcttatgaatgggggaggcatccgggacggcataaaaaaagggccgatcacatggggagatctttataatgtacagccgttcggcaatgtgctgacgaagcttgaaatcaaaggaaaagatttgcgggagatcatcaacgcgcaaatttctccggtgtacggaccggattacagcatcagcggattttcctatacatggaacccggaaaccggacaagcggtggatgtgaaaatggcggacggtacagacatacagcccgaaaaaggatatacagtaacagtcaatcaatttatggcgacggcagcgggggcaaaatacggtccgatcgggaaactcggcaagaatccggtgacggggcctgaggatttggaagcgacagtagactatgtcaaaagcttttccgcaccgatttcttatcaaaccgacggccgcatccgcacggcatcagacgccgaaacacctgatgacaccggcaatcagccgggaagcggggaaacaccgggcagcaccgggcctgataaaggagaaaaacctcaaacggaaaaacccgctaaaaaaccggatgcagcagaacagcctgatcaaaccaaaaaacctaaacgtcctgtcgtaaaagaagcagcatctgatacagtgcagtcaattcccgaatcccgtacggcgtctgccgcagattcggaacgaagcacagaacagactgaaagcggcacacaaaaaggccgcccattgcctgatacttcagcgggcagccatcagacggcattggccggcctggtgatcacgggtgccggcgtatattggcttttcagaaagaaaaggggaacccgcacacgatgaacaaactgaaacatattccgcttctcgtcatcatcgcaggtgttatcatcacatgttacggtagctggaagatcattgattcacatatgaaaacgaaccaatcgcttgaagaagcaaaaaaagcaacagaacctgtcttggaaaagaacgaaacaaaaagcgctgtgcaggcacagcgcaaaaaagaatttcaccccgaaacgggtgaggcaagcggcattttagaaatccctgaaattgacgctgagctcccgatcgtcgaagggactgacgcagatgatttagcaaaaggcgtcggacattataaggacagctattatcctggcgatcacggccaaattgtgttatccggccacagggacacggtgttccgccggaccggcgaactgaaaaaaggagacagactgaacgtgattttgtcttacggcacgttttcttataaaatcagccgtacaaaaatcgtcagccgggatgatacgtctgtcatcacccttcaacacaagcgggaggaactgatcctgaccacttgctatccgttttcttacattggaaatgcgccgaaacgatatattatatatgccgacccggtttaagaaaaatacgtttcggtaaaatgagccagatcagccggcatcggcgcctcggcaacgatttcttctcctgagatcggatggacgacactgacttttttggcgtgaagcgcctgcctgtgaaacagcgccctgcttccgccgtacaggtcatcgcccgccaacggatggccgatgcttgccatatgcaccctgatttgatgtgttctcccggtttccagttcaagctctgccaatgtaagctgcgcaccgggatgatagcctttcactttgtaatgggtgacggcggcttgtccgccgggtgagacgcgccgtctgacggaatgtgacctgtcgcggccgatcggcgagtcaaccgtgccttttttcggcgtgacttttccttccgccgcggcgatataggtgcgttttaatgttttggtttcgagctgacggtcaaggattgcatgggccaggcggtgtttcgcgaaaacgaccgcgcctgacgtgtcacggtcaagacggtgaacgtggcgcactttcgcttgttcgccgttgatttgaaaatggtaagcgatcaggttgctgagggttccggtctgaccctcttcatttggatgagtcggcattcccgccggcttatttgcaatcagcatatgactgtcctcaaataaaatgtccggctctccgtattcaggaattaccgaagaacccgttttttcctgaagatcaatgaataagcggtctccggttttcagtatgatgttgtttttcggggatgtccgattcacctgaatgcttttttggttcatccattccgttatcacgggttttgacgcctggaattcagatttcaggactgaaaacagccattgtccggcgtgtttttccgtaatcaggagttccagaccgcggtcattttgtttcatatcataaagctccttttcaagcggaaagcggctgtttcaataggaaacacttaccttagctttcgcgtttttttctatgctattcttgataaagattaaggatattcacatggcaagaaaggtgattgatgtgagaattgtgaacgcagcgactgacggacaagaaagcgcgatacaagagctttcctctgaattgtttcaaaatgtctttcctctttatttctccgaactggaaattcagcgctttaaaaaaaggggcgtattgtctttacaaaaccaacgttaccaaggaactttaaaagaagcgtttcaaattatggcttgtctgcaaacggtacatatcatgctgtcaaagccgcaccccgtatatgacgtcaaagagcgggcgctgtttgataaaaattgcgctttgctgaatgaatgcggaatgaattttccctttacctatgatgatttcgagacaggggccggatcagaagcctgcggtcacagaaggctgatctgacgggtataaagagccttttgacaggctcttttttgcttccttgacatgataccacaatttctttcctctaactccctttataatgagtcaaatccccgagcataataaaatgcgaaaggggtgctttacaatgagttcaatcaaacaatcaatgactacccacgtggctaccgtttctcccaaccaaacgatccaggaagcggctgcgctgatgcaccagcataatgtcggagcaattcccgtcgttgacggaggggaattaaaaggaatgctgacagaccgtgatatcgcattgagaacaacggctcaaggccgcgacggccaaacacctgtttcacacgtgatgtcttctcaagttgtatccggaaacccggaaatgagtcttgaagaggcgtcacatctgatggcccaacaccaaatccgccgccttcccattgtcgatcaaaatcatctggtcgggatcgttgcgcttggagacttagcggtcgatcagcgttcaaatgagtctgcgggagcggctctttccaatatttccagtcaaaacacacagtaacggatgaagagagcttgcactcatgcaggctcttctttccgtgagaatgttacattttgaatgcaaaagaaattcacggtatagtgtatacataggtcagtacgtttagctaaaggagctgtaaccattgataaaagcattaatctttgattttgacgggttaattttagatacagaaacccatgaatatgaagtgctgcaggaaatgtttgaggaacacggttcaacattgcctttatccgtctggggaaaagtgatcggaacggcggcggggtttaagccgttcgcatatttagaggagcagctgggaagaaagctcgatcatgatgaactgacggcgatcaggcgcgggcgcttcgaacagcggatgaagacggaaacggcgcgtcccggagtggaggcttatttagccgcggcaaaagaattaggattgaaggtggggctcgcttccagctcagattttaaatgggtgtcgggccatctgaaggaattaggcctgtttgatgaatttgaagtgattcagacggctgacgacgtagaagaagtgaagcccaatccggagctctatctgaaagctgcggaacatttaggcgttgaaccttctgaatgtcttgcctttgaggattcggtcaacggctcaatcgcagccaaacgcgccggcatgaaatgtgtcatcgtgccgaataaggtaacgagcgccctgttatttgaagaatacgatcacagactggaatcgatggcggaaatggaacttgaattactcttacagcgattgaacgatcaaaacgaaccggcagggggaagcagcattgtctgagaaacttgatctgacccgttttgaaaagaaaatggtcatacggaatatggaagagaaagatatcaacaaaattattgagctgcaaaaggattgttttccggggatggagccgtgggagcctgagcatttaatcagccatctcgcgcactttccggaaggtcagttttgcgccgagtatgaaggggaaattatcggttcatgctcaagcctgatcatcaatttcgatgaatatgatgaccgccacacgtggcaggacattacagacgacggttatatcacgaaccacaacccggacggattgaatctgtacgggattgaggtaatggttcacccggaatacaggcggatgaaaatcggacaccggctgtatgaggcgagaaaagacttggcgagacgattgaatctgaaaagcatcattatcggcgggcggattccgaattatcataagtacgcggaagaaatgacggcgagagcttatgtcgaacaggtgacgcgccatcagatttatgatccggtgctttctttccagctgatgaacggatttacgctcatgcggatcaatccgaattatctcccggatgacaccgcgtccattaaatatgcgacattaatggaatggaacaatgtcgattatctgccgcagtcaaagcgctattacaaatcggcatttccggtgcgcatctgcgtcattcaatatgaaatgaaaaagatttactccttcgaggaatttgccaatcaggttgaatattatgtcgatgtggcttccgacgcgagatctgatttcgcggtatttccggagattttcacgacgcagctcatgtcatttctcgaggagcgttctccgagtctggccattcagaggattaccgaatataccgaggactatatcagcctctttacagatctcgcggtgaaatataatgtgaacattatcggcggctcccacttcgttgaagaagaggggaaaatttataacatcgcctacttattcagacgtgacggcacgattgaaaaacaatataagcttcacattacgccgaatgagcggaaatggtggggcatcagcgccggagacagggtgcgcgtatttgatacggactgcggaaagatcgccattcagatctgttacgatatcgaatttccggagcttgcgagaattgccgcggatcaaggggcgaaaattatctttacgccattctgcactgaagaccgccaaggctatttgcgcgtaaggtactgctctcaggcgagagcggttgaaaaccaaatttacaccgtcatctcaggtacggtcggaaacctgccgcaaacagaaaatatggatattcaatacgcgcagtcagccatttttgctccgtctgattttgaattcgccagagacggaatcgtcggtgaaacgaatccgaatatcgaaatggtcgtgatcggggacgtggaccttgaaatcttaagaaggcagcgtgaaaacggaaccgtgcgccagctgaaagaccggcgcaaagacatttaccggattacgcatctgaaataaaaaaacgcccgctccgcttaagggcgggtttttttataaaaacacttgcaccggccccggtttcgggatatgctcttgtagccctttcgctttctgggagaaagcgtttttttaattgccgccgctttattgactcgcccatgccgcgcctttatattcttattaagaggaaaacttcaccatgagaatcggcgtcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgtccaaaaaggggaaggcgcctgggttacggacattgacggcagacggtatttggacggcatgtcaggattgtggtgcgtcaatatcggatacgggagaaaggagcttgccgatgcggcttacagccaattgaaggagcttccttattatccgctgacccaaagccatcaacccgcgattgagcttgcggaaaaactgaatgaatggctcggcggcgattatgtaatcttcttttccaacagcggatcggaagcaaatgaaaccgcgttcaaaattgcccgccaataccacattgaaaacggcgatcacagccgcttcaaattcatctcccggtacagaggctatcacggcaatacgatgggggcgctcgccgctaccggccaggcgcagagaaaatataaatatgagccgctctcacaaggttttttgcacgcggcgccgcctgatctttatcggaatcccggcgatgccgtcacattggaaagcgcgcatgaaatcgaccggatcatgacgtgggagttaagcgaaacgattgccggcgttattatggaaccgattattacaggcggagggatactgatgcccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttatctgccgctgtcggcaacggcagtaaaacgggagatttttgaggcgtattcgggcggtgagccgtacggccgcttccggcacgtgaatacattcggaggcaatccggcagcctgcgcccttgctttgaaaaacctgcaattgatggaggacgaaaatctgatcgcccgctcccgggagcttggagaacggctgctccgtgagcttgagccgctcaaagaacatccggcggtcggcgatgtacggggcaaaggccttcttgccggcattgagctcgtcaaggacaaaatcacgaaggaacccgctgatgccgctcttgtgcagcacgtcatcaccgcgtgcagagaaaaaggcctgcttgtcgggaaaaatggtgatactgtagcgggatataataatgtcattcagctgtcaccgcctttttgcctgtccgacgaggagctctctttcatcatttcgaccgtcaaggaaagcgtgctgagcattgatttttaaagtaaaggagtaaaacatgagttttcacaaccagaagattctaccggctatccggaacatgaagcaattcgatgtatttttagagagtccgttcttatacggcgtcattttagatatacacctcggtcaattaaaaggtgtcgtgaatgaagcgaaaaaacacggaaaacttctgatggttcacgtcgatttaattcacggcattaagcatgacgaatacggtgcggagttcatttgtcaggacatccggcccgcgggcatcatttcgacgagatccgccgtcatcgtcaaagcgaaacaaaagaaaatatacgcgatccagcgtctgtttctcttggatacgagcgccatggaaaaaagcatggaattcgtcggaaagcataagcctgactttatcgaggttctcccgggcatcgttccgactttaatcagagaaattaaagaaatgacggggattccgatttttgccggcggcttcatccgcacggagcaggacgttgaaaacgccttgcaggcaggagccacggccgtgacgacttcagacaccgaactatgggctaaatatgaacattctatgacaaaaaaagattgacaccgcttacacccattgttacaatagacctaggttaatactatgtgatggagacccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggaggcggcgtttgtgcgggagtcaacttaaagaaatcgctttcataccaatccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattgcgggacagatgatcggagcaatgatcggtgcggttgttgtgtaccttcattatctgccgcattggaaggcgacggatgatccggccgctaaactgggcgttttctcgaccggcccgagtattcctcatacatttgggaatatgataagtgaagtcattggtacgtttgtgcttgtgctcggcattttggcaatcggagcgaatgaatttacaaaagggctgaacccgctgattgtcggattcctcatcgttgccatcgggatttctcttggagggacgaccggatatgcgatcaaccctgcgcgggatttggggccgagaatcgctcacgcctttctgccgatcccgaaaaaagggccgtcaaattggaaatatgcctggattcccgtaatcggtccgatcatgggcggtgcgttcggcggcgtattttacaatgccgcgtttaaaggaaatgtgacacctagcttttggtttgtaagcgttataatggttgtagtgcttttcatactctatatttataccaagaaatctcaatcacagaaaacattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatttccgagtccggaatcagcgctgatcaaattgccggcatcggcatcacgaaccaaagggaaacgacggtcgtatgggataaagatacgggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggcgcggcgcacgtaacggattattcaaacgcttcaagaacgctgatgtttaatattcatgaattaaaatgggatgacgagctgcttgatattttaggcgtgccgaaatccatgctgccggaagtgaaaccgtcttctcatgtgtacgcgaaaacggttgattatcatttcttcggtaaaaatattccgattgcgggagcggccggagaccagcagtctgcgctgttcggtcaggcgtgctttgaagaaggcatggggaaaaacacatacggcacaggctgctttatgctgatgaataccggagaaaaagccatcacttctgatcacggccttctgacgacaatcgcctggggattagacggaaaagtcgagtatgcgctggaaggaagcatctttgtcgcaggttctgccatccaatggctgagagacggcatgcggatgttccaggattcgaaagaaagcgagacatacgcagagcgtgtggattccgctgacggtgtttatgtcgtgcccgctttcgtcggattgggcacaccgtactgggacagtgacgtgcgcggctcagttttcggcctgacacgcggaacgacgaaggagcattttatccgtgccacgcttgaatctctcgcatatcaggcgaaagatgtgcttgatgccatggaggctgattcaggcatctctttaaaaacattgcgtgtagacggcggagcggtaaaaaataacttcctcatgcagttccagagcgacttgcttgatgtgccggtcgaacgtccggaaattaatgaaacgactgcgctcggtgccgcgtatttagccggaatcgctgtcggctactggaaggacagcactgaaatcgccgatcagtggaaccttgataagcaattcaaaccggaaatggaagatgaaaaacgcgttgaattgtacggcggatggaaaaaagcagtaaatgcagctatggcttttaaataagataaaattatggtatactgaaaacaagttaataggaacggtcctgagatgaggagagaccacagcaccaaagtgatgacatgcgctttggctgttgtggtctctttttctataccgtgacaacaaggaggaagcgtaatgatgaatcaccaattttcaagtttggaacgggatcatatgctggaagacatgactaaaaaaacatacgatctgtttattataggcggaggtattacgggtgccggtacggcgcttgacgctgcttcaaggggaatgaaagtcgctttgagcgaaatgcaggatttcgcggccggcacatcaagccgatccacaaagcttgtccacggcggtttgcgttatctgaagcaatttgaagtcaaaatggtggctgaagtcggtaaggaacgcgccatcgtgtacgaaaacggcccgcacgtcacgacgccggaatggatgctgctgccgtttcataaaggcggcacgttcggttcattctctacttcaatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgctgagcctgtcaactattctaaagtgaaagaactgctttatgaaaaaggaaaagttgtcggcgttttaattgaagatctgctgtcaggcaaggaatacaaagtgtacgccaaaaaaatcgtcaatgcgacaggtccgtgggtcgacgagctgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatacgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggcggacatgtcggcggctctaaaaacttcgagtcatttgtggaagcaaagacaaaagacggcttgaaaatcggtttatcacaggaaacggctaagcagttagccatcagatatggctctaacgttgaaaatgtattcagccggattgaaggactgaaagacgaagcggaaaaacgccagattccggttcacattttggcggaagcggcttacagcatcgaagaagaaatggctgcgacacctgccgatttcttcgtccgcagaacgggaagactgttcttcgacatcaaatgggtgcaaacgtataaaacggccgtgattgattacatgagcgaccgattccaatggaatgacgaaacgaaagaaaaacacactgagtggttaaatacgctgctgcacgacgcggttgttccgctcgaacaataataaccggagggctgtgccgaaaaggcatgagcccttcttttatctttttacataaagcatttggttaagttatcaagtgacacgggcagccgcttcatattaaaatatggtcataagctgaaattataggaggacgaacatgagttggagtaagagttacgaacgctggaatcaggccgaacaattagattcagaattgaaaaaattattggcggacgcagaaggaaacgagcagatgctggaagattttttctacaaaaatcttgagttcggaacaggaggcatgagaggagaaatcgggccgggtacgaacagaatgaacatttacacggtccgcaaagcatccgccggacttgcggcgtatatcgcgaaacagggggaagacgcgaaaaaaagaggggttgcgattgcatacgactcccgtcataaatctcctgagtttgcgatggaagctgcaaaaacccttgcttcccaaggcattcaaacatacgtatttgatgagctccgcccgacgcctgagctgtcttttgcggtgagaaagctgaacgcttatgccggcatcgtcgtgacggccagccataacccgcctgaatataacggatataaagtgtacggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtgcgccgcggtcttgaagcactcggttacaaaaacgtcaccgtcgtaaaggagcaagagctgccggacccggatttttcaaccgtcaaatcgccgaatccggaagagcacgcggcattcgaatatgccattaagctcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgccgtcgcttcatcgttcggattagatacggttgacacgctgacaggcttcaaatttatcggtgaaaagatcaaagaatatgaaaaatcaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtcgctttatgacgcgctgctgtccatttttaaagaatacggatattaccgtgaaggcttgaagtcattgacgttaaaaggaaaacagggagcagagcagatttccgctatcctgacttcattccgaaacgatccgccgaagcagatggccggaaaacaaatcacgcaggctgaagactattcaacgggaaaacggactgtatttgccgatcatcatgaagaagatattgatctgccgaagtcaaatgtcctgaaatatttccttgaagacggctcttggttctgccttcgtccatcaggaacggagccgaaagtgaagttctatttcgccgtgaagggaacttctttacaagacagcgaacagcgtcttgccacattatctgaagcagtcatgaaaacggtggatggcatagtggaaaaaacgaaataaacaacaaaccgccggaagcgacatccggcggtttttttatacgcctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaacgttaaaccaaaaccacgatttaaaggaagcgcttgataaagtgctccgcgaactgctcagcctgaccgggctgcagacagggtggatttttctgattgagccggacgggtcttatacgctcgcagcatccgcttatttaccgcctgctctcggtcagcgggaaaatgcactcatgtgcagcggggaatgctattgtctgaccaaattcagcaatggcggattgacaaaggccgtaaacataatgaattgtaaacggattgaatttgcggaacagacgacgaactgccgcgatacggagggcattacccatcatgcgaccgtaccgcttgaggacggcggccggaagttcggtttattaaacgtcgccgcaagcgaaaagacatttttcaacgaagaagaactgcatctgcttgaagcggttgcatttcaaatcggaacggcgattcagcggatgaaattggccgaatttgagcagcagaacgccctgttgatggaacgaagcagacttgcgcaagagctgcatgattccgtcaatcagatgctgttttccgtgagcttaacggcaaaagccgcaaagagctttacagatgatcatcggctccggcagatgattacgtttattcaagagctgtctcaggatgcgctaacagaaatgagggcgctcatttggcagctgaagccggaaagtttaacgaaagggctgtatgcgtcgatcaaaagctacgccgctcttatcggcctggaagccgtttgtgaagcggaggatgagctggagcttacggatgaacaggaacacgcgctttggcggatcgcccaggaagccttgaataactgtaaaaagcatgcgggaacggaccgggttatcatttccgccgttaaaaagccgggttacgctgagcttcacattagcgaccgcggagcgggcttcagcgctgatacgcatgctgtgctcccatcgctcggcgtggccggcatgaaagcgcgggctgaagcgatcggaggccgctttacattgcaatccgagcttggcgccggaacggttgtctccgttcggcttccgtttcgggacgggaggtctgattgatgaaaattgtgattgctgatgatcatcatgttgtccgcaaaggactgcgctatttcttcgccactcaggaagacattgaagttgtcggtgaggcgtccaccggtgctgaagcgcttcagcaagctgaaaagacggagccggacatcattctgatggatttatcaatgcctgatatggacggcatagaagcggcaaaaattgcggctgaacgatttccggacatcagtatcgtcgttttgacgagctattctgatcaggagcacgtcattcccgcccttaaagccggcgcaaaagcgtatcagctgaaagacgctcagcccgatgatttagtgaaaacgctccgggaagtgtattccggacgttaccggctgtcggcggatattgtgcctcacgtgctgacccatatggttcaggatgatcaggataaggaaaaatattatcagctgaccccccgtgaaaaagatgttcttcaagaaatagccaaaggaaaaagcaataaggaaattgcggcggccctgtttatttcagaaaaaacagtgaagacccacgtgtccaatctgctgtcaaagctgaatctttccgatcggacgcaggcggcattgtatgcggtaaaatataatgttttgggaaaggcggtaaaatcatgagcatattagtgatcagcggcacaccgagaaaaaacgggcggacgagaattgccgcttcttatatcagagatcggtttcataccgattttattgatttgagcgaaagtgaactgccgctttataacggtgaagaagaacagaacgagctgccttcagtgcgaaagttaaggcggcaggtgaaaaagtcagcggccgtcgtcttattatctcccgagtatcacagcggcatgagcggcgctttaaaaaacgccatcgattttttaagcagcgatcactgggcatacaaaccggtggccatcattgccgcggcgggcggaggaaaaggaggcatgaatgcgctggcgaatatgcggacggtcatgcggggcgtctatgcaaatgtcatcccgaaacagctggtcttagacccgattcacatcgacatggagcgccggaccgtatctgaggatatggcggtcagcctgaaagacatgatcgaagagctgaatatgttcacaaacacaagaaatcccggcgtctgacgccgggattgttttatgtcagcatggctaattgatcttcataagcgagctctgtcgcatgatcaatatacccgagaagggaatacagctctttttcaagcacggcatgatcatattcgaaatgatacgcgtgcagaaagtgctcaatacgctttgataataaatcatcttttgtacgaaccatcagaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcactgcggcatagcaatatgagggagacataaaataaaaccgcatatccgtctcttctttggacacgctaagattgacaaaaaacgactcaggagaacataaagatgaaatcccttccatttgcgcttgccctcttgttttgcggcattctcattgcctctatcgctgaaaaagggcatacagaacacctcgatccgtcagttgaaaaatgggaacagctcgcatggaaccagcttgaacgtgaatacaaaggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgaggccgtacagcttatcagatatcagaagaaacgttttgcgccgaggtagcgctgtttccaataggaattgttcatgctggaaataacgacacccgaatcgttggcattaataaactggccgttcccgagataaataccgacgtgggaaggtccggctttataagttgagaaaaagacaaagtcaccgaccgccggctggctgactgatgtcattgtattccagtagcctgcggctgaaagtctggatacagaagtgaccttattgagaacgtaataaatgaaaccgctgcagtcaaagcctctcggcgtcgttccgccccatacatacggtacgcccagctgagcttttgcggcatcgatcattacattaatcttcgcgcttgttgaacctgtgccgcctgtgctgccggactgattcggtgtcgtgtttgtctgctgcccggtaatcgtcagtttctgtccgatttgaagaacatctgttttcagattgtttttctcgcggatctgctgggctgtcacattgaacttttgggcgatcacccataaagaatccccgcttttcacggtatatgtagtggttttccctgtatttccggactggttcggagctgatggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggttttgattttggtttgaattgtcttttgacggcgtgtttcccgaagaagacgttccttttgttttcaggacttggtttacgtagatcgtatccgtttttaagttgtttaatactttgagttccgcaatggtcatattgacgctgtttgcgattttccatagtgaatcgccgagttttactttataggtcccggaagatgatgactgatttttgctgctgtttgagctgctgccaggagcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgagtctccgcttttcactgtatagacgcttttagtcgtgccgctgttctttgaagatggctttttgctgccggaatctgatttgccgttaggaatgttgagcgtctgcccgatagaaagaacagtggattttagatgattcgctgatgtaatggcatccacgcttgtattgtagttttgggcaagcttccataatgaatctccgcttttgaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggagtcaaagcattctacgatgttaaagtcgtcttctgtatgtcgaacgacttctccaatgtttatgtcttccggtgtcattcctaatcgaattccgcctccccggccccggatcgtttcgacatacccgagctggccgagacggtaaatgactttcatgaggtggtttttagagatggaataagtatctgcgatttcttttatgttggaaagttcgtcggaatgtctggaagccaaaaaaatcaaaacgcgtaaagagtaatcggtatagttcgttaatttcatagaatgacctcgaaaaaagagattttgcttctgttacagtctatcatatatgaatctaaaatgaaaaaaaaggaatttgcccttaactcaaaaaaaacgtgcgctccttctgagcacacgtttttttcgttaagacatcggcggcttacgatcgtcagccgattgatgtttttcaattttgcgatccaattttgcgaggtaacgggaggcaaattcttttccgccaagaccgaatgaaagtccgaaggcaagcgcgaaaccgcccagaatcagaataaacgcggcatttacgatcgtgtcggcgacaccgagctgatccagcgccataaagattgagagagtgataatggtatatttcgcaagcggcgccaggaatctgaattcctttccgctcagcatgccggcaagcagcctgctgacaagctgtccggccaaaagtccgattccgagaataaatacagcggccagaacattaggcaggtaagcgataataccggttgcgataacgacgagaaattcgagatgaacaagctgcagcgcctctgccgtaaagagcaggacgatgatgatctgaacaatcatgccgaccgtctgagaaagcgtcagcttcggggtgcccgcctgttcaaagcccattttaccgagaagagagtcaaaaccggcccggtgcaggagcccggatacaatgctgttgacccattttccgacccagatgccggcgatgatcagcacaataccgatgatgatattagggagcattgtgaagaccgtgtgcagcatggctgacgccggttcagaaatacccgccacattaagccggtcaagcgcagagatgatcaccggaatgaaaatcagcacgtagacaatcgttccgatgattgccgacaggctcgtatccttcagataaatggaaagccccatacgtgcggcgagcctttccgttccgatactcgccagaaagtttgtgacgatatcacggacgagacgggcaacaagccagccgattaaaacaatcagcgccgcggcgaataatttcggtataaaggacaaaacgctttgaatcatatttgtaaacggacctgacactccgctgatctggagagcggacaagacgccgggcaggaacaagagcaagacgaagtaaaaaacgattcgtgaagcagccgtaacggatctgctcatctccgcttcttcagacaccattgtccattttctgagccggccgttttcagcgagtttcatgcccgcttttttgacgagatagctgaaaagcgaagcggccgcccagcccacgagcagaatcaagccggcttttaaaacgctcggcacagccgccgttatcgccgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaacagcctgtcgtcgatttttgttttttgcaggcctttgtatacggctttttcaatgattttggcaatgccccagccgataagcaggacgagcagtgcaatgatcagattcgggagtttgctgagatacgtcgtaagcatgtctgctgtattcaagtagaatcgctccttttctttttggggtatggtgtgtgttttacccacttacatataaagcaaacagggcggatgtgccgaaagttttcagtcggaaaccggtctgttatttcatcttttgagaggaggggtcatacattataaataagtccaagtaggggggattcgcttgaacgcggaggagacaaaaggtttacagcgggcaattgaggaaataaccgacattgcgaagggtttcggccttgatttctacccgatgagatatgaaatttgcccggctgaaattatttatacattcggcgcgtacggcatgccgacgagattcagccactggagtttcggcaaacaatttcataagatgaaactccattatgatctcggtttgagcaaaatttatgaacttgtcattaattccaacccttgctacgcttttttgctggacagcaattcgctgatccaaaataaattaattgtagcccatgttcttgcccattgtgattttttcaaaaataactgccgctttcaaaatacgaaccgggacatggttgagagtatggcggctgcggcggagcggattaagcattatgaaagaattcacgggataaaagaggtggagtcctttttagatgccattctggcgattcaggaacatatcgatccgtcgctcgtcaggccgaagctgctgtggagcgtcgatgacgaagaggaggacgaagaagaaaccgcgccatcgccttacgatgatttatggggaatggataagccgaaacaggtgaaaaagaaaaaagggaaaaaaccgtttccgccccgtccggaaaaagatattctgctgtttatcgaggaacattcgcgggagcttgaaccgtggcagcgtgacattttaaccatgatgagagaagaaatgctgtatttctggcctcagctggaaacgaaaatcatgaacgaaggctgggcatcctattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaagacatcgaagagcgttatgacaacccgacagatgaaatgaaaaaaacaggagtaaagcccggttccggacgcgagaaaatgtttgaggtcagggaaattgaatcggatatatcatttatccgcaattatttgacgaaagatctcgtgatgcgtgaggatttgtatttattccaaaagcagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacactggtatgagggaattgagcttgatctgaaatatttggagaaagtgctgccgtatctgcaccagctgtggggcaggagcgtgcacatcgaatctgttcttgaagacagagaagtgatgttttcgtatgacggcaaaggagtgcaccggagatatctgtaaaagaagaaaggatgcggggaaatccccgcatccttttttattttccgtgtttcaggatgtgaaagatctttttggcctggtccgtgttgtttaaaagccccgtaaatgactctcttcccggaccgtatgcgtaaacgggaacttcttcgcccgtatgatcgccggttgtccagccgctgtttgttttcgcattaaaaagcttaatgatcgctttgtagacgctcttgtcagcatcctgttttgcggccgtttcgatctgtttaatttccgcttttgaccatttcaggtctgtataacgcgcaagcacggaagatacggatttgcccgctttgatttggtcagccataaatgccggggtttttttggcggcaagaatcggttcaacatgccagtttttatcgtcattcgcgccgatcgtcaatccgccggtggtatgatcagccgtggcaacgacaagcgtatgtttgtcctttttggcaaatgcgatcgctgctttatacgctttttcaaaatccttcatttcactcattgcgccgactatatcgttgtcatgtcccgcccagtctatttggcttccttcgaccattaagaagaacccttttttatttttgttcagcctgtcgatcgccgctgttgtcatgtcttctaatgaagggacggcatttgaccggtcgattgctttgtcgagtccgccatcggcaaacaggccgagaatcttcttgttacggtcctttttcagctcctgttttgatgtcacgtagctgtatcccgcttttttgaaatcctttgttacattgcggtctttacggataaagtttgatttgccgcctccgaggagcacatcgactttttgttttccgttgatgcggtcatcaaagtagctgcttgcgatctcatccatgttctttcgggatttgttatgggctccgaatgccgcaggggtggcgtgggcaatctccgaagttgcgacaagtccggtggatttccctctttgtttcgcttcttcgaggacggatttgacccgctttccttttttatcgactccgatcgccgcgttatacgttttcacgcccgtggccattgccgtgccagccgccgcggaatcggtaatattggaatcaggatcgtcaggataagtcatcatcataccggcgagattggggtcgaatgccgtcagtttcataccatccgaaggctttcctttgttaatgaccgaacggtaggcgttcatatagggtgcgcccattccgtcgccgaccatgaagatgacgtttctgatctcgtttttgtcaggctgtttttttgccgcagcctgttcagagtgctgaaaccccgcgcccgcaatcagaccggctgtcagcacggatacggctgccgccggcagaagttttgatcgaacctgtttaaatagactcattctcactcgtcctcctttaatcgtgtctgcatgtctaatggtagggggtgtttgtaaagagcgcctgttcctcctgtaaatttcaggtgaaacattgttagaaatgtaaattccggtgtaacttatgttttcaagaaagagtgaaaaccattcacttttttgaaaaagacgaggatttttttaacaaggagttatttggaaagtaaactgctttgtttttccaaaatacgaggatcacaggaaaaaaacatgacaaattgactcgtttttcgtcacgtttgaaatcaaattgaaatatttaatacccttaaaaacttttttcaaaaacgaattagtaagaaatttgtcacgggaagtcaagtctatttctagtggaaattgaaccttataataggaaacagataaaaactttaaaaaagagacacataaaatagatagaatcattcagggaggaaaatatgaaaaagcaacttgttacagcaacaacggcagtggttttggggacgactttgtttgcgggcgcggcgtctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagtgcttaaagtaaaaggatcaacttccggttcagcgtcttcaggatcttcgtcatcaaagaagccttcatccagccataatattgcacagacgagcctgaatgtaaacaagctggtttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtatccagcccgtcaagaggagacttcgtcttctttacaacatatcaagccggtccttcacacatgggtgtatacatcggaaacaacaagttcatccatgccggttctgacggcgtcacaacaagtgatctgaataacagctactggaaaccgcgctacctgggcgcgaaaagattctagcagtgagagaaacccgttcatccgaacgggttttttatttagacggggcagagctccatttgtttcacctaaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggaccgtaccgctgacagcggcagaaatgagacgcccagcccctctttaataaatcgtttcgtaatatgcgtctgtgtcaccttcattgtcctgacgaaagggaactgtattctgacctggcggagcaaatcatcccaatagtcaggatggttatgggtcaaaagcagatattgtccgaacaggtctttcacttcatccgccttccctgtcccgggttttcggccgggtggcgcgacgaggacaacggggtcattgtacagggggaggcaagtgagggaagatgattgcacctttaagcagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagcgtgtgcgagtagccctggcgcaccctgtgcagctccgccatgctgttttcatagtcttccaaaagtctcatggcaaacggcacgtatgcttttccttcttccgtcaattgtattttccggccgctccgctgaaacagcttgcagctgatttctttctctaataattttatatgaacggtgacggtcggctgagataaaaaaagcgtttccgccgtttttctgaaattctcgtattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggcgatcagccacattgacggagaaaaggggcatttaatatatcgcggctatgacgcgaaggatatcgcattgcaattcagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcaggtttgggcacagattcatttacatatccgcccaagccggaagaagcgattaaactgattgccgtcacaccgacgattattgcgtacagataccgccgtaaacaagggcaggaagcgctgtcacccgaggcgcgatacggacacgttgaaaactatttgtatatgctgacaggcaggcagccgtccgcagcccaaaagaaagcgcttgagacgtatatgattctggcgatggaacacgggatgaatgcatcgactttttcagcgagagtcacggtttcgactgaatcggacttagtgtctgccgtcactgccgcactgggtacgatgaaagggccgctgcacggaggcgcgccttcaggcgtcacgaaaatgcttgaagacatcggggaaaaagaaaatgcagaagcgtatttgacagcgaagcttatgaggggagaacgcctgatgggcttcgggcacagggtgtacaaaacaaaagacccgcgggcggaagcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacagaccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatagacagacagacggaaggacaaaagccgcaggtgcaaaaccgccagcccggcattgagtcagacatggagccaaaaccgctcttggaggatccggatgtaaaagggtcgggcagattaaaaggaaaagtcgccgttattacgggcggagacagcggcatcggcgcagcggctgcgatcgcttacgcgaaggaaggggcggatcttgccatcctgtacctagacgaacatgccgatgccgagagaacgaaaaagcgtgcgagagaataccaggccgattgcctgttaattccgggagacgtcggtgatgaggcgcattgtcagaaggcggtccggcaagtcttagatcactacggaaaaatagatattctcgttaataatgcggctgagcagcatccgcaaaacgggattcttgatattacggctgaacagctggagaagacattccgtacaaacatgttttccatgtttcatatgacaaaagccgtgctgcctcatctcaaaagagggagcgccatcattaatacaacgtcgattaccgcttatcagggagacacatcattgatcgactattcgtgcacgaaaggcggcatcgtttcctttacgcgttcaatggcgatgtcattggccgatcaggggatcagagtaaatgcggtggcacccgggccgatctggaccgccctgattccggcaacgtttactgaagaaaaggtggaaaagcacggtctggacactccgatgggaagaccgggacagcctgcggaacacgcaggagcttatgtgcttctggcttcagacgaatcttcctatatgactgggcagaccattcacgtaaatggaggcaggtttatttcaacataatacgcaagttttatcccgcgcttttaaaaagggcgggatttttatttgattacatatgaatacgatttttaaaaaatagaagccgccagctgaattactaatgttaatatttcatagcggagaatccgctgatttctgttttatgaaaactgaaataatatatagaattttcaaaaaaagttattttcatttttatatttttcgctataatatgatgtaggagaaaggaatgatgtgctgaaacatttcatgcgaaaaataagaatttagtcattattgctattgttatctgaatattctaacatatattgatttacaaggagtgaagcagatgaaggggagcatattcagaaagaaaagcattcaggacctgcttgccgcaacgggcggggaaaagtcgctgaaaagagagttaggggcctttgatttgacccttctggggataggggccatcatcggaacgggaatttttgtattaaccggaacaggtgctgtcacggcggggccggggctgaccgtttcatttgtcatcgccgctcttgcgtgtttatttgcggctttgtcatatgccgaatttgcttcaagcgtcccggtttccggttccgtctacacgtttacttatgcgacactgggtgaacttctcgcatttatcatcggatgggatttaatcttggaatatatgctcgccgtcagcgcggtttcggtcggctggtccggctattttcaatcattcttggcgggcttcggcattcatcttccgactgcattaacggccgcgccgggatccattaaaggcacggtcacattctttaatctccccgcatttgttatcgtgcttgcgattacattcctcctctacttaggcattaaggaatcgaagcgggtcaataatattatggtcattttgaaggttctggttgttctattgtttatcgccgttgcggccgtatatgtcaaacctcataactggcagccgtttataccgatggggttcggcggtgttttcagtgccgcggcgctcgttttcttctcttttatcggttttgacgccgtctcttccgccgctgaagaaacgaaaaatccggcgaaggatctgccgaaaggaattatcttttcattaatcgtctgcaccgtgctgtatgtgaccgtatcggcgattatgacgggcgtcgttccgtttgcccgctttgaaggcgttgaccatcccgtgtctctcgtcctgcagatggccggacagaattgggtggccgggattattgatatcggcgcagtgttgggaatgacaacggtgatgctcgtcatgctgtacggccagacgagggtgatgtttgccatgtcccgtgacggtttggtgccgggggcgctttcaaaagtccatccgaagcataaaacgccgcacgtggtgacatgggtgttcggcatcctgtcggcattactcggctcgctcgtcccgcttgatgagctggcgaagctggtgaacatcggcacgcttgccgcgtttgtcctgatttcagtggcggttatcgtattgagaaagaaacagcctgatctgccgagagcttttaaatgtccgggggttccctttattccgatattgtccattctgttctgcgtatttttgattattaaccttggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagtgaataagggataatatagggcggaagggaagtggaaagtcgtgtctgaccaaaaaagggttcaatgggcctcaaaaataggatttattatggccgctgccggttcggcgatcggcctgggagccatttggaagttcccttacgtagcgggtacgaacggaggaggcgctttttttcttgtattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgacagtggcggtcgtcgcaaaaggcgtgcagaaagggattgaacgtgtcagtgcggtgctgatgccggttttattcgtgctgtttctattgcttgtgctgcgatcagtcacgctcgatcatgccgttgaggggattagatttttattggttccgcactttgaagatttgacgccggaatccatcctatatgctttaggacaggcgttctttacattaacgctcggcgtttcggtcatggtgacatacagttcgtatctgccgaaaacccaaaaccttccgggatcggcaggttccattgttgtgatgaatgtgctcgtcacgctgtttgcgggactggccatttttccggcggttttttcgttcggatttaaaccggatgaagggcctacactgctgtttaccgtactgccggctgtgtttgaccggctgccgttcggctcgctgttttttatcagctttctggcggtctttttctttgccgcgctgacttcggccttttcgatggtggaaattatcgtagcgactgtcgggaaaggtgatgaaacgaaaaggaagaagctgtcgtggacaagcggtctgctcattttcttagtcggaattccgtcgtgtttatcatacggtgtgctcggtgatgttcatttgttcggaaaaacgttttttgatctagcggatttcacagtgagcaatgtgctgattccgctcggcgctttattaatatcaatcttcatcccgctgaaaataccgaagcgggagctgttcgccgagatgaaaagcggttccgccatcggctatcgtttctttcaggtgtggtatttccttctgaaatatctcgtgccgctggctatcatcgtcgtattgctgcatttaatcggcgttctttcattttaaaaaaacaggcccccgtaaaagggcctgtttttatatttaaaaaccgaattgcagattcgtatcaacggcaacgatcgtatatacacagacaatgacgaaaaggttgaggatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttgtttttcagcagacgttcgatttcttttgtcggccccgtcacgacagagccgtatacgttcattccgtgatgttcaacatagtcgattcggctgccaagattcatgtctttgcgtttcgatattgcatgcgcccattttttatggcgggacataaattcaagggcattgataaattgttcacggtctgtctgtccttgcgtttcgaaagaggacaccatcttggaatctttcccgggaaatcctaacggctcggcataaggactgtctttcagatttttctccgtttcgaccgcgttccataaaaacttcacatcgtattttttaaaagtagaatatacttgagaagaaggataggcccggtcataagaaagatagacctccgccacgcttccttcaggcaatttttttaatgtctgtccggctttgtcaatcgtgcgttcctttaagccggaaggatgggcaaaataatgctttgcctgtgccgcgtctagatcatagtagttaacggcaggcgatttgaccgtatctaaaaacatttcaatccgttctccgccgacggatttcgtttttgtgccgatctgcttttgcagcggaaactctgtattcatcccaaacagcttcacctggcttttcagtccggaggtatcgacgagtacgttcggcatggtggtcgccaccgtcacggctgcggtttccattaattgattgccggtgctttcttttcctcccaaaccgtaatagaggtagcttcccaaagtgcaaagcggcaaaatcatcaaggtggagatgacggcgagaactgaaatccgcaaatacgatttgcgttttccgtatgacaaaatggccttctgtttttccgggctgatgccgacgtcccattcccggtcgtcctgcatttcgctttcaatcaactcctgatagacttcaagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatatatttattagtaccaggtaataaaaaatattgttataatagagagagaacacttttgatcattacaacaaaggaagtgcgttatgtataagttttgtgcaaatgccatcaaattcattctttctctgcgcggaggagtcaaagtatacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggaagttttttaaagaagattcacgcgtttccggttgatcgtgaaaatccgggtccgagcagcattaaaacgccgattaagcttctgaaggaagggaagattgtcgggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcagtttccagcagttcatcaaacgccagttttttcacttcgatatatgcgacgtggtggccgtcaatttcattaatgataaattcacagccttcttcgataatcgagtcgtattgttcgacgtcgtatttctgggtaaggaaccagccgccgatggtgtcgacctcgtcattttccaaatggatgccgagtagttcgttcacttgatcaatcaggaccttgccgtcaagcatgtaatggccgtcgccgagtttgcggatttcattgatttcatcgatatcaaattcatcacggatttccccgacgatttcttcaataatgtcttcaacggtgacaagccccgcggttccgccgtattcatccgacagaatcgccatatgaacccgttccttctgcatttttacaagcagatcgtgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatatccatcatttcagaaattttgatatcatgcggcagactgacgatttccgtacgcggaatcatgatttcttttgcaagtctgtcgtcaaattcaaagattttgttcacatatttaaattcagactggttgatttcaccgcttttatagctttccgataaaatgatgcgcagctcttcttcagagtgggcaagctcattttcagacaccgtctccagaccgaacgtcttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaacgtaatgatcgcgtaggcgagaataaatgaaataatatgcgataatgagcttggtacgtttatctttgtgaaaagcgggtgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcaactaaaatcaaattcacaatgtccaattagaaccttcactccttttgggaagatgaaggtaacacctcctgttagtaagataatggtttaacttaacagcagcataaatgattgaagcactgcaagcttttcaggagccagcctttttttcagctgggcgcgctcctctggttcaagcttttcaaaccgattcaagatcccggagatgttttgattcatgtgatcaatttccgatgccagatttccaacatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggggcggcaggctgtctgaaaaagcgttgactgcgccatgtaaatctttcataatcattgtaaatagaaacggcagaaaaagacagaagggacagatgacagtggccggtttatcaagggaagtgacacagaacctggagaaaggttcatggatacgcaaactatttgatgaaggcgctcggctgaaaaaagagttcggcgccgataaggtgtttgacttttcaataggaaatccggttgcggagccgcctgaaacgtttaaaaaggcgctttgcgaagcggctgaaacagggcggcacggatacatacaaaaccaagggcttccggaggcgagagaaaaggttgcccgctttttgtcagagcggtttcagacagaaatttccgccaggcatacagttatgacggtcggagccggcggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcaccccccgtacgaaaggactgatcgttaatacgccgcataatccgacggggactgtgctcagccagaaaaaccttaacgaattaggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcgttcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaggtggcgttctgcatgcatgccgcacagaaatacagactattgatcgtacccggcagcggatttggaaaaagcggctatttccgattatctttcagcgtgccttcggaacagatcagacagtcgcgcgatattttcaaagcactgtatcaagatttttcttcatagcttccaatacataaagatgggagaacggacaaatgtcgaggagaaataatggcacatcagacatcagcattacaggaatcggagtcttaaccgcggtcggacaaggcaaggaggcgtttctcgatgcgctcatggaggggcggcacgcctttgatgtgatgaaacgtcccggccggcagaaaggcagttcgtttatcggcgcggagcttagcgaattaacgccgccggacgcgctgtcgaagcgcttgtaccgaagggccgcattatcaggaaagacggcgcttatcgctttatatgaagcgtggcatgacgctcaattagacggcgctgatcacagccgcaccggtctgatcatcggcgggtcgaatatgacgcagcgcgaattgctgcaggcctttgagaaaaacggtgaaacgccgcaatttgtaaatccgacatacgggctttcttttatggatagtgatttgtcggggctttgcacggagcaattcgggataaaagggccggcctttacggtcggcggcgcgtcggcaagcggccaggcggcggttatccaggctgctcaaggaatcataggaggcctgtttgaccggtgcatcgtgatcggggcgctggccgatctgtcgtacatggagtgtcacgctctccgttctttgggagcgatgggcactgatacatacgctgaacggcctgaagccgcctgccgcccgtttgaccggcatacggacgggtttatattcggagaggcgtgcggggcgattgtgctggaacgcgctgaatctgccgaagagaggggcgcacgatcgtgggccggcttaaagggctgggggatggcttccgatgcgaaccgcaacccgaatccttcagcagagggcgaaatgacggtgatccgccaggcgatggagcgggccggtctttcagcgaaagagatcgattacatcaacccgcacggcaccggttcgccgatcggagataagactgaatgccgggcgctttctgaaagcggcctgtcgcacgcgcggattaatgcgacaaaatcgattaccggacacggtctgagtgcggccggaacggtggaaatcattgctgttctcttgcaaatgcgggaaaacaagcttcatccgatccgaaacttaacggagccgattgacgattcatttcagtgggtgaccgacgggccgagcgtccataccgtacaccatgcgttaagcttaagcatgggattcggggggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcatttttcgtggcgagtgaatttgcgatcgtcagagtgaggagatccagaatcgatcagctcatctcagaaggaaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggtatggggctgccggattcagccgagcatgtgattgcttttgctgcggcgtacgggctgattacgtttttacatgtcgtcgtcggtgagcttgcgcctaaaacggttgcgattcaaaaagcggaaaagctgacgttatggattgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggtgaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagcggaagtatccatcatgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatacttgaagaaatcgtcggcgatatcagagacgaatttgatgaggacgaacagccgcagattcaaaagctgtccgaacgccattatgtgctggacggaaaggttcggatcgatcaggtgaatcatcttctcggcgcagagattgaagaggaagtcgacacgatcggcggtcttgtgctgaaacggaatattgacatttgtgcgggtgagtcgatacaaatcgggggatacactgccctcatattagaaatggacggccggtttattaaacagcttgaactcaaagaagaacagggccgcccgggcggtcaggggacaataaaccgcccgctgcccgtgccggaaacggtcatgcttcataacgcaaccttgagcgaaaaataagctcaaggtttttttaaatggatatcataacaaagccgcaccagaacgccaaaaggcttccggctgctgaaacagcgatgtagagcaggctttcctttatgcggttgttcatcatcagctgcacggcttcaatactgaaggtggaaaaggtcgtaaacgcaccgaaaaagcccgtcgcgatgatgacgccggcagaaggattatccagacccaagccggtgaatatgccgaggccgaaggagccgagcaggttgaccgcagccattccaagcggaatcggaaaaccttttgttctttctgaaattgtcttacccagcagagaccgtaataccgctccgatacccgccgcgataagcatcaggacaatcgtcatggcgtatcatgcccccttccggctgcgtgaagggcaatccgccgtcccaaaaaaatgccggcgtatgcaagagcaagaccagtgaataaagtcgcggcagcataacaaaaagccgctgcgggagacgattgcagcagaaaaatggtttcttttgcgaaggttgacatcgtcgtgaaacctccgcaaaaaccggttcctaaaaaggcgttcaaaagagggcgtttagcccgaatgatgaaataacccgtaataagaccgagtaaaaggcttcccgccgcgttttcgaggaaagtggcacccgggaaagttccgctgtgaatgtgcgcgctcatttcaaagcggagcaatgcgccaagcgcgcctccgataaaaattgcgatgtattgtttcatatcagccatccttagaaataatatccggaaaatcagttacaatgccgtcaactgccatcatttgcagcttttcggccgtcttgtgatttctgaccgtccaggcaaatactttcaggccgtgtttgtgagcggtggaaatcaagaaccgattcaggcgggtatatttaatattgacataatttgcggctgatttgtaagcggccagctggcttttggaaaacatcccgaagctgggtcttgcgataattgcagtcggaacggacggatacatgtcgtgaaaggtctgaatcgacttgagactgaatgattgaacgatagggtgaatggaaaaggtaaacctgcttaacagctggccgactgctttttcaagaccgacttgagaaacgtgccctttcagttcaattaaaaatccgatttcagaatgataacgcttcagaacctcttcgagcaggggaatccgctcccctttaaactcagccccataccagctgccggcgtccagagactgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcagtttacaatccgcagtgatgatttataatggcaaaaaggaggcgagatcatgggaaaagggagattgaaagtggaagaaagaattaaggccgaaaccgatgctgaaatccaaaaagcgactctcctgaaacagacacaatcaaagaagaaatagtgcctgaccctgttgtatctggctgaaagatgaacgaatgtgtgaaaaaccccggctgtgctctgaggccggggtttttcaggctgcctaaagacattaaaacaagctgatgtccgaatgttttagtataatagattttcgacaagacaaaggagcatatgccatgatgacacaatttcagagcttttttactcttgaccatattttgcagatcagtatcagcatcggaattttagcggcttttctcgttttgagaaaactgtttgtcaaatacttttttcagctcatttacaaattggcgaacaagccgaaaaccgacatattcaaacagattgccgtagcgtttgacaagccggccagatggtttttcgtggcgctgggtctgtttttggcgattgagtattcgccgtttttagacgggcagatggacattgtcaaaaaaatgtaccgctctttgatcatagcgctgatcgcctgggggctttgcaatctgacatcggcgtcttcgtttttatttcataaagtcaatcagcgctttgagcttgatatggatgacattttggcgccgtttttatccaaggtgctgcgctttgtcattctcgcgctcagcgtcagtgtgatcgcgcaggaattcaattatgatgtaaacgggttcgtggccggactcggacttggcggcttggccttcgcgcttgcggctaaagatacgatcagcaattttttcggcggcattatcatcattacggaaaagccgtttacgatcggcgactgggtcgagacgtcatctgtgacggggggcgttgaagatatcacattccgaagcacaaggttccggacggcgcagggggcgcttgttaccgtacccaattcaacgctgtccatggaagccatcacaaactggacgaggatgacgaagcgccaggtcacgttttccgttcgtgtttcttatgcgacgccgattgatcgtttagagcggtgtatcacaaggctcagggaaatgcttcgtgaacatgaaggcgtgcatgatgatacgattatggttaactttgacgtgtttgcggacagctattacaatctgtttttcaacttttacacaaagaccatcgtctgggcggaaagcctggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggcggtggaagagtggaagcgtttataacattgatcaatcaggctgaacgtatcctggtgctgacgggagcgggaatgagcacggaatccggcattcccgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaacattgacggactgcataagaaagcgggaagcagcagtgtctatgagcttcacggttcaattcagaccgccgcatgcccccgctgcggagcgcgctacgggctttctcatctgctgaaggacgaagtgccggaatgtacggccgaaatcggtgatcatgcggtatgcggcaccgtattaaagacggatgtcgtgctgttcggcgatctcgttcagcattttgaaaccctttatgaaaagcttgataaagctgatcttcttcttgtgatcggcacttcgcttgaagtggcgccggcaaggtttgtccctgaggatgcgggccggattcccggtttgaagcaagtgatcattaaccttgagccgacatattgcgaccatttatttgatcttgtcatccatgagaagatcggtgaatttgcaaaacggatcagcgccgcgacataaaaaaagccggatcctatacagatccggcttttcttattcatggacgggaatcatttgatccgtcagaacatcaaaggagtagccctgggctttcagtttttggatcaggctcggtaaagcgtgcaccgtcgcaggcagatcgtgcattaaaatgacatgcggcctgctcgtatgaacgctttccaaatatgcgagctgattcaatacttccggcacgtaccgcgcgtttttgtacttccagtcttcactgtctatcgtccagtcccagtacacgaatccgtctttttcgagattcttaatctgggcatccgtcaatgacggtttactgccgtaaggcgtgcggacaagatccgtttttactccagtgattgtctcgagcgtatcgcgtccctgctgcatttcgttcagcggtgatgtcggtgtttgataaaacaggtgattatcgtgcgtcacgccgtgcaggcccagcgcgatcccttcctgcttcgctctttgcacggaatgcttatagtctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagccaatgaaaacagagaaggggaagcaccttcttttgtgttgcgcataacaatctctccagtagcataagtttctgcataatgccgataacagcggaggcttgcgaagtgctataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgcacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgcccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggattggagccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatgataaaacaaaaagcctatgaagcaggcgcttatgaagccgtgctgataagggacggggcggtcacggaaggaacctcatccaatgtatacgccgtcataaacggcaccgtccggacgcatcctgcaaatgagctgattttaaacggcattacgcggatgaaactattagagctgatgaaagaaaacgggattgaggtgcgggagaaggctcttaccgaagaggaactcagagatgcggatgaaattttcatctcgtcaaccacgtctgaattaatcccgatcgtaacccttgacggaaaaccggtcggaagcggatcgccgggacctgtagccaaaacgattcaggaggcttttcagtcgcacattcagcaggagctcggcgttcagtcataagctgaaaaaaaggccggaacacatccggcctttttgctccagtcagataaaaagagattcgatatgctgaacgagtacacgggagatcttctcttttgaaagacgatcaggttcaagcatggcatgcagcgccaatccgtcggcgatagcgtacattttctccgcttcggtttctttatcaagattcggtttcagaagcttattttcatccagccagtcaatcaggccgcggatatatgccaagatcccgtcctgctggggttgaaactcttctcccttatgtctggcataagctgtgaaagcgaaccacacctccatttcagccatcgtttcttcatctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtattaaataaaaagcagtgatacaatgcattttagaaaacgataagggggaaccggattgaacgcgattgcttggttgattgtcatttgtgaggctgctttttgggcggctgtcatcttcggattggctgcgcgctatatattcaggcggcaaaagctcggaatgttttttttcgctctcattcctatattggatgccgtactgtttctggcggccgcagctgatttatacagaggggcggcggcgactatggcgcatgcagtggcggccgtttatatcggagtgtctgtcgccttcggaaaaagcatgattcagtgggcggatgagcggttccgctattatgtggtaaaggaaggggcaaaaccggtcaagcggtacggactggattatgccaaacattatgcaaaaggatggggaagacatgtattagcatttgtcatcggcggcgttcttttagccggaacggtatttctcattcaggacgcttcccgcaccgaagcgctcagcggactgttaaagggctggtctgtcgtattgtgcatcgattttttgatcatggcgagtttttttgtaatgccgaaaaaaagaaaaaacagccgggagctgtaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctgaagcgggtcaggaacgcttgcaatcccgccgccgatatacgttgccccggctcccggcctcgggggatcaacaatcgtctgggtatcttttgcattgtgggaatgtacgaccgttaaatccgcgtggaacgtttttgaaaggtctatggctttttgaagcgcttttttactatcatcacttccgtcaaaagctgctatcaaccggtctgcgtgaaacatcagcctcatcctttcagtaaaaaaggtttgttttacaatacccgtgcggcagaaatgtaaaacccgcattgacaaaaaaaggatttatttatatgatgaaggaacaatataggaaaaaggaggtatggatcatgtcaaaactaaagcttgtcaactcatcttcagctgaataccggcgtgacttccatacagcttccgttttctgaacatttgcttaaaaacggggcagtcgcgcataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattgattgtgaatgtcattgagatgtttccgcctaaacttctcggtaatgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaaaattctccggtcaaagctgatgggaaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtatccggcgtccgggtcatccgggcatttgtgcaggaaaaaaatgatgtcagcaggttcggtgatatgacggcggatgtatatgagaaaaatatgaaggtggcgtttatcgattcactttttgaaccgactgtgaaacttctcgtcggcctcagctatctcataggtctcggctacggcgcttatctcgtttttcaaaaccggctgacgctgggagagctggtatcgtttaacgtgtacctcggaatgatgatctggccgatgtttgcgatcggagaattaatcaatatcatgcagcgcggcaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcatcgtcgggaagacgggaagcggaaagacgacgatcattaagcagctgctgcgtgaatatccgcccggtgcgggagaggtcacgtttacaggcgtcccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatctcaattgcgagagcgcttttgaccgatcctgatattctcatattagatgattcgctttctgccgtagacgcgaaaacggaagccgccatcattgacggcatccgtaaaaaacggcggcataaaacaacgattatcaccacccaccggctctcggcagttgaacacgcagatctcattctcgtcatggacgaaggccgggtgtctgaaagaggcacgcaccgggagctattggcgcagaacggctggtatcgaaaacaatatgagaggcagcagctgtcctctcttgaagaaggggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgatgaccacattctcggcattgaaaaaacatgggttaaagcctctgcggacgatccgggcgccgtcaggttccgggggcatgattatgtcagggaggaccggctcaaaccgggggcggataaaaccggagaggcgcacatttatcaagtcggtgcgggctactattttgttgaccgtcccgtcagttttgacggaaaccgttcggtgtctgacggccggctgacaatatcaaacggtaaagaaagcaggtcatatcccgccattacgttatcgagacaggagatttttgaattttaccgtccggaaattaaaggattgctgacgttgaccgccatttatgcgggattgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtgagggatttatatgtaacggtgctgtcgacatttatcacaagcggcgtttatatgctcggcatttttacggcgctgtttatgcttgacgtcaggctggccgccgtttgccttctgattattccgattttaatgatctggtcggttgtgtaccgcaaatacgcatccgtcttcaatcaaaaaatccgttccattaacagtgacatcaatgcgaaaatgaatgagtccattcaaggaatgccgattattcaggcgttccgccgcgagaaggaaacgatgaaggaatttgaagaattgaatgaagctcatttccgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacggggattgtcaaccaattttcgaagcttgaattggcccgtgtctctgccgccagagtattcgagcttttacaggaggaggaaacggaagaagaaggcgctcccgcagacagaaaggcggaagggacagtggaattccgcgatgtttcttttggatatcgaaagggagaagaggtgctgaaacacatcagctttacagctgaaaaaggggagacggtcgccctcgtcggccatacggggtccggcaaaagctccatcctgaatcttctgttccgtttttatgatgcccaaaaaggggatatcctgctggacggtaaaagcatatacagcatgtcaaggcaggagctgaggtcgcatatgggcattgtgctgcaagacccgtatcttttctcgggcacgatcggctccaatgtgacactcgatgatcagcgtatttctctggagcaggcggaagaagcgcttcgccaagtcggcgccgcaagccttctgcaatctttgccgaagggcatcagagagcccgtcaccgaaaaaggcggcacactgtcctcaggccagcgtcagctgatttcttttgcaagagcgcttgtgtttgatccggccattttaattttggatgaggcgacggcgcacattgataccgaaacagaagcagtcattcaaaaagcgctgcaagtggttcaagaagggcgcacgacatttattatcgcccatcggctttccacgatcagacacgcagaccagattctcgtgctggaaaagggccgcatcattgaaaagggaagccatgacgaattaatggcgcaaaaggggcagtaccatcaaatgtatgaattacagaaaggaacggcgaaatccgcggtgtaatcggaaagggtgaatcaaaagattcgcccttttttcattcagtaagccagtcccacccgttttctgacaaactgcgggctgatcagctcgcggtacagaaagtgcgccgtgtctccgactgtgatttgagcgccgttttcaggaaggcgatcctgttcgaaacggtacactccggcagcgtctccgtcaggaaggtaggtggggcagatgatcgtccagtcaagatcctctgccagcagcatctcgtatacgcgggcgtgttcctttgcggctcttgttgattttcgttttgattctgccgattcaaaacggtattgatcaggcataatccgtgattgaaggatacccgcggtgccgatcgtaatcagacgctgaacatgatgccgtttcatgccgtctattatatgggtcatagcggctgaaagggtatcgtcaccgtccgtgccgagacagctcacgactgtgtccgctttggaaatcaatcggctgacatcttcccgccgcctcgcattccctgttatgatctgtttttcaggaatgggaaggactgttccggctgatctgacaagagcgaatatttccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtggaataggaaaaaagggtgacggcataaaagaagacgcggtaacccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaagggcatctcattcggaaaaccgggtggtaaatagcggaagggaaaagaaaagcccagcctgatgcggctgagcttttagctttcagtcatatatgtgataaagcattaattcgtgcagctcttttacgagagccggctcttcttttcccggatgtgtgtgtccccattcaatgtcaccggacttatggtaaaccccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttccggggcggtgatggaccgttctgataaataggacgcgtattcaaaatttctccgttttgtcaggtaatcgaccgatctcagcttcggatgggaaaaaatgctgcgcccggggcgggaattggcttcaaacatccaaactttccctgaatgatcgacgccgaggtcaaaaccgatttcgccgataaaaccttcaatgtgctcatttaacacgcggctgaccgccaaggcggctttggaaagtttccgcatcatgccgactctctctcgcggatcgccgtataattcagctaacgtcctgacttctccgccggttgccagatgcgtcgtgatgctgttttcaccggaaatttttgctgcaatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcaccaccgttttttcctcattcgtgtgtttgacagataagccggcatctgttttttccaccctgtaaatccccgttccgagtgcgccgtctgcaggtttgatatagacggtgtcaaatgtgttgcataacgtctctaacgcctctgcattcgggtgcaggacagattttggcaggagtgaagcggtgaggctgtttttttccagaagcttatgaatgtcccatttattaaagaattgcggattaaaccacggaatctgatagtcattcatcagcctctgttttgtctgctgtaaaagcggaactccttccgtttttcggctcgggagcctgtcatatacgacattcggaagcgggacggacgtccgtttccagctgttttctttataaatcagcgcttggacggtgccttcttcccagttgatctgatgagctccgaaaacgaaacaatatccgttcgcctgttcatgaagtgagagcatcttggaaaagaaggctgtacgatctcttaacgggcgggacggcgatgatgtgaaaccggctgtgaaaacgccgatcagcggcccgatgtgcaccgtctggccgtgtatgagaaagtcagcccggcttttatacggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcccttcctgctgtcctgtgactgaagttcgcggaagcgtctcagcggacccgtatacaaatcctctttcgcctccggagccacgcttaaaatagctttccgtcccggctttgaattgacatccaaaagccagatgcgtccgtctttggcataacaaatatcgagccccagctcaaacagcggtccgaaccgttcatcaaggaaataaggaacggattgggtgatcgaaaagacatcatccaataaaacggcctgctgctttctcggaatttcctcaaaccatgtgtcaaacttaatcgggtctgatcctccgggcaaatgagataaaagaccgttctgataaccccttctgaccgcttttccgaccgtttcccaaacgcctgactccgttttgcgcatgaaaatgcggatgtcgcacggatgccgttctttatcctggatatttaagtaggattgaagcaaatagcggtgctgcagcacttttttgcaccaagacttaaaagacacgtgattggaaaatgattttgtttgtttgttttttccgatatagtaagtggcggtaattgattttttgcctgtttcaagcaggatgatgcctctgcctcccgcgccgaaagcgggcttaagtatacatgctttttccttggctaagtataattgcacctgttcatagcggctgacttcggccgtttcaggaatatagggactgatcagatgatgcttttggagcgcatccgtgaccgtccatttatcaggaagcccccgcccgataaattccgttttcggatattttttcagccattcgacgatcggtttggctttttgcgcttcagcggattttccgtaaaaacagcggtcgtaaatatattcgggaatatcgatttccgtttcgttccactttccgctttgcgggtgatagacgagcgctttcacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattactactccccctttattcaaaaagccgctgatggaacggcccttccatccaataaatatgctaagcgcatcataaaagatgatctactgtaaagagtacgaaacagcatcttgccttattcctcacaaacaacaattcaggttcttcatttgcccgcatgcccgccagcctctataatacgaatagatatatcatcaagaaaatagaacattagatggaggcagaagaaaaggaatgggcatagcaggaacgtttctatttatgatcgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccaccttttaaccccggaaggaataaaaaagcggcttttatcagataacgttaaaaaccaggcgcttcttttcgccgaacaattcacgcaaaaaatggccgcttccgaaatgacggtgcacgaagctttagcagccgcgggcattcggaatccgcaggaaaagacggatgcctggattgaccgttttaccgatgaaaagctttcggacctgtaccggaaatatgagcaccgcgccatcaaagactggcttcctgatgagctgcaggaaaagctggatgaaaaaatcccgctggccgcagattatatcctgaagcgtagcattgattattttgagagcgaagaagggaaagacagactcggaaatatgattgacgactttttgaattcccgggggatgctcggcggcatggtgcagatgttcctcggcaattcaagcttggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccaaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatccgcaaaacgcatgtttgataacttccgcaatgtacagctgcagctgcagcagaagcagatgtcaggtgaagaaatcactcaggaagaggtagagcaggcacaaaaaaccgttgctctcgtacagcagcatgaattgatttctcagctgatggaagcggaacagcgcatgagcatgctgatcggcgagttaaacaaaatcattatgaaacctcttgaagagctttacggcagcccgcaataagctccacacccctccatctatgaaatggaggggtttttttattcaacagaaaaatcaagagaaccttttaccgttccgttaatgatgacagacagagtgtgaattccccgataatgcttgcgggtggttaaatctttaagggaatgatgtttgctgaaggcttttacgtctccgttatccatggcggactccgacatcttaaacaccttgcggctgcggtgcccccttttctttacaaaatcaatcgcgtattcaaccctgactttttgccgggcggatgagcggacctgaaaagaaaaatgtatgcttgttccgatggcggccgtttccggattcagtgtaaaacgttccaatgaaatccgggaggcgtcttcaaacccgaaaatcgcaagcgcctgtttgtctcctctttttaacagtgtcctgcaggcgtgcttcaaaatccaatccgtgtgcggacagcttccgaaccgctcggctgcgatctgtgccagaagatccggatgtgttttggagatgtcattcaggttattcgccacgctttttctgacatataacgagtcatcctgcatcaagcggtccagaacagggagaatcggagaagggtcgtcaagaagagccggaatggagattccccacggcaggcgcggtcttgagccttcgctggcaagccttctgacatgttcgtccggatgctccgtccaggaaaggaactctttgaacatccgctcccggtcaagcctgatatacgggcggaccgcaaattcggaagtggaaaaacgagtgaaaaactgaagcgccttcattgatgcttcccagtgatccgttccgtactgttggacataatcgggaaaaataatcccggcgagccctgtgaaatggggagctgtctcatataagacgtcaagcgcccgtatgtaatcctttggcagtgtttcatataaagagtctgtgatccggcgcatccgctgttttaacgtcagtccgggccaatcttcctgaaatatcagcgcccggcacttgtcccgctcaaaagccggatacgccgatttgactctgtgcagaagtgcttctgcaaattcttcgttataaatatcttttaatagagacatgacagtcaccgctttttttcttttattatatgcgaatatacgttccctttcaactttatcatacattcagcacagatatttcccctgatttttttagttaaaaaaacccttgttttttaacaatattattgagataataactctgaaagcgcctacacttacagatgatctaaggatacggtcgcctatactgcctggtatgttaaggggtagcaacagagagtaagtgaaacgagcgcatcaacggtcaaataaggggttcctgatatatttcgttaatagaaatgcacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaagggatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctcgaaagctatcaatgcaatatccggcttcttcacgaaaaatattcgatcggtaacaagaagaaagtgaactccaatctggtcgggaaaacgatgattcatccgtctgacccgatcttttatccggtgcagtttgtcgaatcattaagtgacctgctccttgatgagccggtttcagcgcccgtcattgaagtgcatgctgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgaactcgggctttcaatggaagaggttgtggctatcggccatcaggaagatgatctcccgatgatcgagctggccggtctcggcgtcgcgatggggaatgcctcaaatgaattaaaaagaaaagcggactgggtgacaaggtcaaatgatgaacagggagtcgcttatatgattaaggaatatttccgcatgcagcaccgtaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcatatcggatgacaggctgcatcgtccgctgcaaaacatcgcgaatttattttttgaagagtgtgttcttgcgtacggcgaaacggaggaaccctctgatctcgtcatctcacttgccatttctcaagatgcagacagcgtgtcggtatccggagaaatcaaaggaaccggcgaaaaggaacatcacaggaaaccgcttcttgccggatggagcgaaaaagaagtatttaaacaggtgaaaaacacgctgtcatatgtctacttaaatcttcttcaatcgcatacgggcatgacacaaaaatggggaatcttaaccggcatcaggcctactaaacttcttcataaaaagctgcagagcggcctgacaaaagaagaggcgcatgccgatctgaaaaaagattatctgatccatgatgaaaaaattaatctgatgcaggagattgtcgaccgtcagctcgctgcggttcccgatctgtaccgggtcaaagatgaagtcagcatatatatcggcatcccgttctgcccgacaaaatgcgcctactgcacgtttccggcttatgccattcaaggacaggcgggaagagtcggctcctttttatgggggcttcactatgaaatgcagaaaatcggagaatggctgaagcggcatgatatcaaagtgacgaccatttatttcggcggcggcacgccgacaagcattaccgctgaagaaatggatcttttatatgaagaaatggtccgctctttcccggatgtcgcgaatatcagggagattaccgttgaagcgggccgtcccgacacgattacggaggaaaagcttgccgttttaaataagtataagattgacagaatcagcatcaacccgcaatcttatgaaaacgaaacgcttaaggccatcggcagacaccataccgttgaagaaaccatcgaaaaataccatctttcccgcaaacacggcatgaataatatcaacatggacctgatcatcggcctgccgggagaagggacggctgagttcaggcacagtcttgaagaaacggaaaagctcatgcctgaatctttgaccgttcatacgctttcttttaaacgggcgtcagaaatgacgagaaacaagcataagtataaagttgccgacagacaggaagtgtcccgcatgatggatgacgccgtccgctggacaaaagagcacggctatacgccgtactacttgtaccggcagaaaaacattctcggaaaccttgaaaatgtcggctactccttcccgggtcaggaaagcatctacaacattatgattatggaagaagtgcagacgattatcggtatcggctgcggggcggcaagcaaattcattgatccggaaaccggaaaaatcacgcacttcgccaatccgaaagacccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgtaaaaacgggaaaagatcatcagactgttattcgcaagaggtgcataatatgtatgatgtcataggagcgggaatcgggccgtttaatttagggcttgccgcattgttagaggatatacccggaacagacgctctttttttcgataaaaagaaagaatttgcgtggcatcccggtctattaattaaaggaacggatttacaggtggcgtttctggcggacctggtcacgctcgccgatccgaaaagccgctacacgtttttaaactttctccatgaacatgaccggctgtaccggttttatacgtttaatgaatttgatattccgagacgggaatttaacgactatttaagctgggcggcttcagaaatcaaatcatgccgtttcggctcagaggtaatcggcgtgaaaaatgccggcggacattatgaagtcagcgtcaaaaacattgaggacggaagcatcagtgtctatcagacgaagcatttcgtcatggggacggggtctgaaccgcttattcccgcagagattgatgacggggcgcgtcaggacacgatggtcagcacggaatatttgttccggaaagacgagctcgccggcgccgaatcaattacggtggtcggctccggacagagcgccgcggagatcttttctgacttattgcatgatgaacaataccggcgcagccggctgcaatgggtgacacgctccgccggatttcgagaattggaaaccgccaagctcgggcaggaaatgtttacacctgattatgtggaatattttaaccgcctgccttttaaagaacggctgaacacactccctgagctggacggactgcgccacggcattgattctgacacacttgccgccatttacgacgccctgtatcacagatcgatcagcggaggttcgcctgacgtgtatattcagccgatggcggagcttgaaaaaattgaaaagcaaaacgggcgctgtgtactgagctttcatcaatggcagatggatgaaacttttacggccgattcagaaaaagtgatattggcgaccggctttaaacctcatattccggaatggtttacggcaatcgcccccgatatcgaatgggaggatgagaaacggtttaaagtgacggccgattcccgtcttgtctttaaggacgacagacggcatcattttttcacattaacgaatcttgatcatgctcacggaacgggcgctacgaatttgaagctgtctgtttacagaaaccaaaaaatcatcaataccattctgggaaaagagcatttctccattaataaaaaaacggcttttcagcaatttcttcccgctcaaaaaaactgacctcttatgaagaggtcagttttttttatgatttctgcggcttcttttcaggcgtcttccatttgaatacgctgttcagcaggagatatatccgcttcgattctttcgtgagcaaagggccgaagatggccagtatcaaaacatataaggcggcgaaaggtttaagtgaagcggacaggccgccggcgatgccgagatttgcgacgataatggagaattcgccgcgggacacaatggtcagcccgatattggacgatgctttatgagaaagccccgcccggcgcccggcgatcatgccggcgataaagtttccggcaatcgtcagcagaacggcgccgagggcaagccataccgcatctccgagtgaaaacggatcaatgctgaggccgaagctgaagaaaaacatggcgccgaaaaagtcacggaacggcacgacaagatgctcaatcctgtcagaatgggccgtctccgaaaacacgagcccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaatttccgggcggcaatgaaaaacagcagcatatagccgaaagcgatcacgattgacatcagcgcgcccccgacagacgtcgcgtctcccagaacaagcccggaaacgacggacaagtaaaccgccaggaagatatcctcaaacataatgatgccgagaatcagctccgtttccggattggccgtgcgctttaagtcgacaagcacctttgcgacaatggcgcttgatgatatcgtgatgacgcccgccaatacaagcacttccaaaaaggaaaagcccgtgataaagccgtagatcagccctaaactgaaattaatcagaatataaatcgttccgccggcggcgattgaacgtccggatttgactaattttccgaccgagaattcaagcccgaggtaaaagaggaggaacaggacgcccatccgtccgaaaaattcaatcacttcccggctttcgataaacgtcaggtcaatgatgcccgcctggggcgcgtgcggcccgacaagcattcctaaaatgatcaggaaggggatgatcgagaatttaattttattggcgatgacactcgcaatggctacaagaactaacgccgtaccgacttcaaatacgagatggtccataaacagatcacactccgtctctggagaggaagtcttggatcagttttttcagatgctttctttcacctgagaggacgagtgtatcgtttgcttcaaggagcgaatcagcccccgggtttaaaaactttttctggtcatgctttatgatggcgataaccgtcacgtcatagttttggcgcacatccagttcgccgagcgtccgccctgccgcttttgcccctttttcaactttaaaccattcgataatcagatcgctgaacgccatttcaatcgattcaagcgcctgcggtttgtacaccatcccgccgataatcgcggcaatctgtcttgcttccgcatcatcaagtgaaatgcttgccagaagctcatcagggtcgcggtcatcaaatctgtaaatttcccgcctgccgtcatcatgaatgatgatcgtcattttttcatgatttctcgtttcgatttcgaattttttcccgatgccgggcagatcgttttctttaatattcataaaaaatccctccggaatatactgtttttacaccgtaagtacagattggtaatgagaaatggtctgctgccggaggtaatttgactggtattgtatcggaatggcgcatgtcctttccagtgtggaatcaatgaattgatcaagaggtttgacagataacagggagatcatccgggataacgcaccgtatccttttgacaggccttgcggagcggttttggtttgaaccggcgtctttgccgattccgtttcctgcgggtagaccgaaatttgtacatggctgtctgtttctgtcaccaattgggaaggaagagcgacatccgaaggggggaaaagcaccataaaaaagctcagtaacaagctgagtatcacatatttcattatcggtgtttttcccccctttttgttttgtatatcaatttcactatataaaaatgtatgttcagtttcaaatgatatgcattttttggtatctgttgaccttgaaaaataaaggagtttcgcatcgggggaaggaatatatcatttgaacaaaatatgtaagcggattcaaggagggagtaaacatgcagtatattcgttatgaagaaaagggaaagatcgcagagattgtgctgaaccggcctgacagttacaacgcgctgaatgaacaaatgctccgggaattggaaaatgcatgcgttatggcagccgacagcgaagcgcttatcgtcctcttgcggggggaaggccgggggttttccgcgggcggtgatatccagatgatgacgtcggatcatgattcgggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctgcagagggggcacaaccgtatatcgaccgattgctgcatgcgccgctgtcagcgatgattgaaacgaaggctatttatcagagcctccatatcagccggttaaaagacgttttatctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcggtgagtactgttctcaagctttttttcctttaacaaagcctctccggcggccttcgcctccgcctcattatctgcttcgatccgttcatccagcagcgtttctcccgacgcatggaatgcggtcaatacatattgtcccatcatgtcaccccctttatagaatgatattctgataaagaatttaaaatcctccattaatttttacccattattagtatataatgggtcaaggaaggagttggattcgtgcttacaattgaaaatgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaagggaagccggtcaattattccatcagtgaaaaaatcggctatctcccggaagaacgggggctgtatccgaaagtgaaggtgagtgaccagcttgtctatctggcgagattaaaaggaatgagcaaaaaagaggcggaaaaagagctcatgacatggctcgaacgcttcggcattacagattacaagaataagaaagtcgaagagctgtcaaaaggaaaccagcagaaaatccagttcatttcggccgtcctgcataagcctgaactgctgattctcgatgaacctttcagcggtcttgatccggtgaatgtcgagctgctgaaagaagcggttatttctttgaaaaacagcggcgtttccatcgttttttcaagccaccgaatggagcatgtggaagaactttgcgagaatttgtgcattctccagaagggaaaacccgtcgttcaaggcaatctgaaagacattaagcggtctttcggcaaaaaaaatgtcaccgttcattcagatgatgacctcagctttttaaaaacgcatgaaggtgtcgtgaaatggaaggaaacaaatgacggaatcagactgcaggtcgcgaatgaaccggtttcgcaggatattttccgggcgctgcaagggaaaggttttatacggaagttcgaattggaagagccgtcactgcatgatatttttatagaaaaggtgggggccgtatatgaataaattttggattatgctgtttcatacatataaaaacaaaatcgcaacaaagtcattcattatttcgaccgccattaccgttttattagtattagcggtgaccaacctgcaatcgattatttccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgtgtcaaagacggtgaatgggacggactgtttatcatcagacaggatcaaaaaggaacgataacgggagcatacaaggcgctgaccatttctgatgaatcagcgtataaactgctcaagcaggctttaacccagacgaaaaccgctgtcgaaaccgccaagctcggcatttcggcagaaaaagtcagcagcctctacactccgccggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcagcgggttatctctcactgaagctgaaccctcaaaatgatgcgtcgtcgccgatcagtgcattcctcaattttacggatgttcccgtctcgacgatagtctatgccgtcattttctatttgctcggctattttctttacgcgacgcttgccgcgtttctcggcagtgttgtcagccggatagaggacgtacagcagacgattcagccgatggtttttttggtcgtggcaggttttatgatcgccatgttcggcatcggcaatcctgacgccggttttattaccgttacatcttacattccgtttttcacgccgatgattatgtttttacgcgtcgggatgctcgatatcccgttttggcaggctgcggccggaatcgccctgacactggtcactattgtgatctttgcggcggtcggcgcgaaaatttacaaaggcggcgttttgatttacggaaacgccagcggattcaaagcgatcaaacaagcgctgcgcatctccaaaaaataaatgaaacagcccggaacagccgggctgtttttttattttacagaacgtgcattcgtataaaaacggtgctaaaataagggtaattcaatctgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgtctgacggacggggcactccgggagcaggcagatttcgtgctgctttcgggggatctgtttgacgaagccaacagaagtttaaaagcccagctgtttttgagaaaacagtttacgagattacaggaagcgggtatccaagtgttcgtcatattcggcaaccatgatcatttgggcggtaagtggacgccgattgaatggccggaaaatgtacatatattcacctcgggtacaccggaggaaaaatctttctttaaaaacggagagcttgcggcaagcatatacggatgcagctatcaggaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccagcatcccgccgctatttaccccgggaatattcaagcccggcatttaaaagaaaccgggcctaagggatattatctcgtccgggcggcaaacggtgagatgtcttgggaattcaaagaagcgcatgatgtgttatgggaggaaattgatcttgatatctccggagctgaacatatgacttcacttctgaaagccgcatcggatacattctccggcttgcgcgcggcgggtcgcccggcatgtgtcaggctggtgcttcgcggcgcggcgccccgcttttggacggaggcgcccgcaggcatcgcagaggagtttctttccgctttacaggaggaagaggccgaagaggaatgtttcgtctggccgctagcgcttgaagatcggacggatgaaacagacagcgtgccgcccgatccgttttttaaagggctgcttcaggacatagaacaatgcgcggacatgagcggtgtatttgaagcccttgagcgtcatcccgtatatcggcgtcagatcacttcatttacagatgaagagatactggatattaagcggcaggctcaagccgttttaagacgccagatgaaggagcttcagcgatgaaaataacggcaatgcatatttaccaatacggaaaattttccgaccgaagttttcagctgtcagattctcccgtgcaagtgatctacggattaaatgaagcgggcaaaacaacattgatgtccttcatcaaaagcgtgctgttcggttttccgaaatcaaaaaaatacgaaccgaaaaacggcggggtttacggcggcactgtggaattgaagcatggcgatcacggtgccgtcaaaatcgaacggacaaaaggtgctgccgaaaaagtcagagtgtatacggcttcaggcgaaataaaggacggagaatggctcaaacagcttctttgcgatacagatcgggcgctgtacgaggcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgacaggatgtataagccgaacgggcggaacccccgcttaaatcaggagttgcatacattaaagcggctcagcgcccagctgaaacaggcggaagctgcggaagcgggctatcacagccttctggaagagaaaaaaagcgccggcggccgtttgcaggatgccgaagcacgattgaaagacataactgaagaaatcaaaacagtaaaatcggcgatagaagcaaagccgctcgcagacaaaaaaacagccttggaaagcgaactttcttcttatccggatgcattgaagcaattcccgaaggacgggatgcatcagcttgaaaaatacgaatcgcatctccatccgaaagctgcccgtcttgagggacttcgggcaaaagcggctgaactcaggcggcaggctgagctgctcgctccaaatgaggacttgctgcaaacagagcggcagctgcaggagctttccggcgagcagcatatgtacgaatcgcgcggcgaacagcttgccgccatccaatcacagatccggcagacatctgcccgcgttttgtcaggattgcagcagctcggaagacatgaggaagacgacattctttcactgaacaccgattatgaatatgaatggcggctgcaggaagccgtgcagagcgccggacaggcaagagaaagaaagacacagcttgatgcgattttcgaacaagcgcggctggagctggaagaagccgaacgaaaacatgccttgacgtcggaaaacattttggaccccgctgtcaggaaagaaaaagaagccgctttacaatcatataagcaaacggctgatacagaaggaaacgaatggcaggcacatgtacagcagctggaaaaacagcgcgccaaacaaaaaaagctctttctcggtgcgggcattctgttcattgcgattttcgctatgttaaaggaatggctgcccgccgccctttttaccggcgctctgctgctgtatatgctgtccggcatgcaaaaaccgctgccgtcagaaagaggaggggccggtcacaagaaaaagaagccgacgatctccaaagaagcggctgaccttctgcaggaagagctttggcgtgacggccggcaccggcagcagctgattgcggatcaagccgtgcttgaacagaaagaagcggcatatgaaagagtcatccgccaatatgaagaatgggaggcggaaatggcgccgtctgaaaaacaggcggaactttttatgaaggaactgggtttttcaggaagtccttcccatcttcttgacgcatatcatgtgatgaaagatgtcaaaaaagaaatccttaataagcatgagctgaccattgaagcgggccggctgcaaaagctgcaaagagcatttgaggaccgggtcaaaaagctgagtccttcagacggaagggagctgtccgtaaaagaaagactgcgcgttttgctggtacaggcggaacgggcccgtgaggaagcaaaacgaaagcaggcgctcgaaacggatctgctgcatgcacaagagcaaatgcgtgaattaaacgaagaagtccattactacgaacagcaggtcaaacagcttttcatggcggcaggcgcaaaaaatcgcgaacacttttgtgaactcgccagactgaatgaaagccgccgggaaacagagcggcagctgcgcgaaatcaaaacgcacttgtccggcataggcggaaaactgcttgagccgtatatgagccgcacagtgtccgaacttgaacatacagtcgttcagaaggaaacagagaaaaaaacgcttgaggaaaaaagcgcgcagctccgtgagaaaaccgctttattaacggtgaaacaagagcagctggagtcctcggggcttgtatccgatttaaaacagcagacagaaatgcagaaggagcgcgtgaaaaaaaccgctaaagagtgggccgcattacagacggtcagacacatcatcagggaaaaaatggagcggcataaaaaagtgacgcttccccgtctgttagaaaccgccggtgcattatacggaccgcttacggacggacgttaccataaattgtatttctccgaggcggatgattccattatggtcatgcggaaagacggaactgtgttttcagcaggcgaactgtcacaggcggcatgcgagcagctttatgcggcgatccgttttgcccttgcgtcagagagggaatctgcggtatcacttccgtttttacttgatgacagttttgtccattttgacaggcagcggctggagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaagggaatcgcaagcaacggaaaaccattcctgacgttaatgctgcaggaccaatcgggagatatcgaagcgaagttgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccgattccgaaaaatgaaatgatggaaactgtcactcaatacatttttgaaatgaaaaatccaaatatccagcggatcacaagacatctggtcaaaaaatatgcggctgagtttatggattacccggcggcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacgacgtacaccgtggaagggaatctgctcgggcacatttcgatcatggtgacagagctttcaaaagcagccgaagagcttcagattgacgctgaagaagtgctgattctgaagcatttgattttaagccatcacggaaaagcggaatggggaagcccgaaaccgccgatggtgaaagaagcggaaattctgcactacattgacaatctggatgcaaaaatgatcatgatggacagagcgctggaacgggtgaagccgggcgaatacacagagcgtgtatttgcgctggaaaaccgttctttctacaaaccgacgttccatcaataagataaaaaggccgattctctatgatcggtcttttttacgttcagctctcataacttgtctttatcaagcatagcttagaataaagactctgggtgaaaaagggaggaaaccgacgtgctattttttccttggtgggtatacctttgcattatcggaattattttcagcgcctataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacacggatgcagaagaaaactccaatcattccatcgcataaaaaaactgtgcggctcgccgagagcccgcacagttttttttatttagattcagaagaagttgaagtgttaaacgtgtcttttaagtctttgtcttccacttttacgtcagcttttttcatgactttttgaattgccgcctgtacagctgagttgtcgtttaatttctgtttaagaacttcttctttcaattcttttttcatgtcatcatatttgccgcgttcttctgtctttttgatgatatgataaccgaattttgttttgaccggatcgctgacttgtccgactttcagaccgaatgcagctttgctgaatgtttcatccattgactttttatcgaaccagccaaggtcgccgccgttgtcttttgagttgtcagttgaatattctttcgcaagcgtttcaaacttctcgccttttttcagttttttctccacttcatcagctgtctttttgtcagcgacaagaatgtggctcgcgcggattttaccttttaagccgtcgtaatattctttcgtatcagcgtcagtcactttgatgttgtctttcgccgctttttgtgcaagcagttcgtacttcacctgatctttcaggtaatcttcgccgtactgctgtttaagggcgctgtactgatcgccgagctgcgttttgtactctttcagcttgttatcgatttctttatccgatactttgtatttttttgctaatactttttcttgtacgagctgtgtcagcacacttgcgcccgcggtttttttcatattcgtgtagagttcgccttttgttacatttccggcatccgtcttggcaatcacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcactgctcgtagtactgttcatattgcttatcatcgtaggtgcagcttacatttgttaagcgaaacgggtcgctttttctaaaagcggtccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcgggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttatgaaataaagaataaacagggcagccacgataaaatagaataaaatgatgggagattccccctctctctgaactgctcccatattacattaccaaatatttattaaaaaagatagaatgtaacctgaaaaatcagcgggatatcaagactccggcactttttttactaaaatatcaaaaccgtcggattcctggtcaatcagacatgatttgggcgctttgaccaggtgcagcgcaaacagaagatcaggcaggcaataacccgcatgaatgctcgaaatcatataaaagtaatgagcgtgtctcggaaatgccagtccggcataaaacaatagcggcgtaatgaataaaaacgggctgatcgtagaaatcagcatcgtcgttttcggtatgcctttccatgtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaaataaccccggaaagggaagaacagaagagctcggtgaaacatggaaatgtacggtttaacctttcttctccattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctggagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagaatttattgagataatgaagcactttgattaactgttgatcggttccagctcttcagccgtttcatggacagccgattcgtccgtttttttcttcagccttccgtcttcactatcaaaatcattgtttatgtttgtcaatgatttctcgaatatctccataaaatcttcgccgtaaatgtggcggatgacacaggttaattcttcaacttccggaaacttcccgaataagtggtagatcggctgtgagcctttaaacaccgcgtttctagacgggtcaaactcctcaagcaggctttcgaatacattttccccttcttctgttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagtgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttaatccgttgctgtgaaaggctttaaaccgcaaaaaaaaagtgcggaacgcaatatgcccgcactttttttggttgtataggatattagttttgtaaggttttctccagctgtctgattttctcttcaatatcagcgatttccttttggagatcctgctggtgcggcttgatttcctcctgccaccttttaatgctggtctgaagctctccgcctacgtctttaatgacttctgcgctttctttcgccgtttggacaagctggtccttaagcgccattccgtctttttttaaccgtttgattgtgtcctcaattgaattgcaattcgctttgattttgccccgcagctcttttccggatgaaggagccgaaagtaacaccgctgcgcctccgatcaatccgcctacgaaaaggcctgttaaaagggaacgtccgtcagccatttaaaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcgcattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgcattcagcgcagccgccggaaggacgaccgcgagcaccaaggcggtgaatccgcccggcaggccgacaatcagaagggccagcgccagaaagagcaaaccggagatgaaggtgccggctattgtaatgacggcggcggccgctgttttcacgctctttttcaccaaaagcgccagcgcgagaaacagaaacgccgttaccggtttttcaatgatattcggaagctgtccgcccggaaaagatgtcgtgagtgcggaaatgattcccgttacaatcccgatcatcagcacgttctgcacacgggggaataacagaatacccataaacatcatcacaagcatcatatcgggtttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttttcataaactgagccagtttttcacaatcagccaggctgacggcgttgtagatagacgccctgcatcctccgactgagcggtggcctccgagtccggtcattttagccgctttcgcttcttcaacgaattttttcgtgagactgctgtcgcggagggtgaacgtgacgttcatgtgagaacggctgtcttttgcggcatgccccgcgtaaaaaccgccgcttgcgtcgattgtgccgtacaggacgtcggccttttcctgattgcgccgttcagccgctttgacacctccgttttcagccagccattcaaggacgaggctcagcatataaatcgcaaatgtaggcggcgtattatacagtgaatcggcttttgtatgagtggagtatttcaaaattttagggacgttggcgttttcgttttcaagccatgattttttcatgatgacgaccgtgacgccggacgggccgaggtttttctgggcgccgccatagatgacatcaaacgttttgacatcaatttttctgctcaggatgtcgcttgacatgtcggctacgagcgggatcggtgaattcgggaactctttccactgcgttccgaaaatcgtgttattggacgtaagatgcaggtaggcgccgtctttgattcctgtgaggtccgcttccggtatatggttgtggtttgaatctgcgcttgttgccgtgacggatgtgtttccgaacagtttcgcctcggcgagtgctttttcagaccatgcgcccgttacgatgaagtgagccgtttgctccggcgttaaaaagttcatcggcagcatggagaattgaaggcttgcgccgccttgaagaaataaaatatcataatcgtcgggaatatccatcagttctttcagaaggctttttgctttttgatgcaccgcatcatattctttgctccggtgggacagctccatgacggacatgccggtgtcattgaagttgacaaattctttctgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgttgccggacgcaaaaaaacctcatctttaagatgaggcaagccgttttctgacggttgaagcgatctcctgaagatcgtcaggcgtatagtcttcggcgtgggtcttccagacagccccgaaaccgtcgccttttccgtaacgcggaatgatatgcatgtgaaaatggaacaccgattggcccgctttttcaccgttattattgagaatattcagcccgatcggctcgaattcatcgcggatggcgcgtgcgactttcggcaccgcttcgaaatattctttagaaagctcaggcgtaaactcgtacacgttttcgatatgtgttttcggaatcacgagcgtatggccttttgtgacttggctgatatcaagaaacgccacaacatgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggtcaaaacaaaaaacaggatgaacggctgcgcgttcaccctgatgcagaagtacgagctttatcacagaaaattaaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatgttgattttcatccaactgttctaagacgtcttttataaacacctcattttcagttgattaaagctgtttccttctacatacattatgatgtccgccaaaacgataactatgcacgcttttcacgtgagaaaaaaagggaatcgtttcaaatcagactttatttttggtactatgaagaaaaacgaatcagaaggggagaaattatgtctctgctatcggtaaaagacttaaccggcggttatacgagaaacccggtcttaaaaaatgtttcattcacccttgagccgaaccagattgtcggactcatcggattaaacggcgcgggcaaaagcacgacgatccggcatattatcggattaatggacccgcataaaggctcgatcgagctgaacggcaagacgttttcggaggataaggaaagctaccgctcgcaatttacgtacatccccgaaacgccggtgctgtatgaagaactgacgctcaaagagcatctggagctgacggccatggcgtacggcctttccaaagaaacgcttgaaaaaaggcttcctccgcttttgaaagaattcagaatggaaaaaaggctgaaatggtttcccgctcacttttccaaagggatgaagcagaaggtcatgatcatgtgcgcgtttctcgcggagccctcgctttatatcattgacgagccgtttctcggccttgacccgcttgcgatcaatgcattgctggagcggatggacgccgcgaaaaaagccggatcaagcgtgctgatgtcaacgcatatcctggctacggcagagcgctactgtgacgcattcattattttacataacggcgaagtgcgggcaagcggcacactggaagaactgagagagcagttcggcatgaaagacgcagctcttgatgacttgtatattgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacatccccgttcattttccctctttttgggtgatggcggtgctcttttcatttgtgctgaccggttcatacgtccggacgctgttaaaggaagcggacctcgtgtttctgctgccgcttgaaccgaaaatggggacatactttaagcattcatttaagtacagctatctgtcacagctgtttccgcttattgctctgtctcttgtatgcatgcctctgtttttcgctgtaagtccgggggcgtcgcttgcgtcgtatgccgccgtatttattcagatgctggcggtaaaagcgtggaatcaggccatggagtggcggatgacgtttatgaatgacagaagcatgaaaatgatggatgcggtcatacgctttatctgcaatatgctgcttttatacttcgtcttacagtcgttttatgtgtacgctgccgccgtctacattgtgatggccggcctttatgtgtatttcacatcagccgcaaaacataaatcattaaaatgggaagctcatattgaatatgaattaagaaggaagcagcggttttacagaatcgccaatctgtttaccgatgtgcctcacctgaaaaaacaggcaaaacgccgggcgtatctcgactttttgctcagaatgattccgtttgagcagcggaaaacgttctcctatatgtatgcgcgggcctttctgcgttcaaatgattatctcggcattcaggtcaggctcacgattatttttatcctgattattatgctcgtttccgccaatccgtggatcacggcggcgttaaccgtatttaccgtctttattacgggaatacagcttcttccgctgttcgggcattttcatcatctttctctgcaggagctttacccggtcaatcagaaagcgaagctgcaaagtttcttttcgctgatgaaatcgtcattaaccgtgcaggcgctgctgttctgcgcagcgtcagcctatgccgcgggagtcagcggggtgctgtatgcggccgttgcttcagccgttctgatttttgtgatcatgccatcgtatatgggcggaagattgaaaaagtacggcaagctgtaatcaatcgggtttttgaaacctcaatgaaagaaggagacacagatgaccgacgatcagcagctggtacaggaagcactgcaatggaaagcgcgttttttgcgcaaagattccatgcttgaacgcttttctaaaggaatgcaggcgaaaataaatgagcggattcccgaaaaaattcatgccgtcatcacagaaagcattaaaaaaatgaccgaagcaacaatggcgggttcaaatctggtgaaaagcaagcgggatacaaacggtatgacgcttgctgaaaaagatgctctcgccagacaaaccatcgcatcgtaccaaaaggtcgcggcagctgaaggtatcggtacgggggccggcggaatttttttaggaatggctgattttcctttgctgctatccattaaaatgaaatgtctgttcgatcttgcctccatttacggctatgatgtgaaagacagggatgagcgattgtttttgctgtttatttttcagctggctttctcaagcggtgaacagcggaaacgcatatactcaatgattgaacagtgggattcgaaaaagcatgatgtcgattggagagtttttcagcaggaataccgcgattatctggacgtggtcaaattgtttcagcttttgccggtcgtcggagccgccgtgggcggagcggccaattataaactgctgtcacagctcggtgagacggcaaggcacgtttttcatttaagaattacaacagccggtacgtaatgtaccggctgttttttttatgtcagcgggggtagcttaccgcggcgccgataagcaccttggcggccgtcagcatcgctttttcattaaaatcaaatttcgggtggtgatgaggataaacggtttccgcattttctaaagcggcgcccgtaaagaaaaaagcgccttttgtatgctgcagataataggaaaaatcctctcccgccatctgcggctctccttcaacgactttcgtaacgccgtctgtttccgctgcggctgccgccgcgtgcgccgcttcctcaggatgattgacgacggcgggatagccgcgtttgaaacgatattcataggaagcggagtgcatggaacagattccttttacgacggcttctatttctgcttcgagcaggccgcgcacactttcgtcaaacgagcggacggtgcctgaaatgactgcctgatcggcaatcgcattaaacggattttcagcggtgaacgagcctgctgagatgacggccggctgcaccggatttacccgccggctgacgatatgctgaagagccgtgacgatttgtgagccgattaaaacggcgtccttcgtatcgtgagggatcgcaccgtgaccgcctttgccgatgactttaatcgtaaagccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcgatacagcacttttccggccgcgagcagagccgccgtatggccgtcatgcccgcaggcgtgcatgacgccgggaatttgtgaagcataaggcacatctttttcatcctgtatcggcaaagcgtcaaaatcagctctgagtgccacgaccggtcccggttcaccgccttcaatacaggctgtgacaccgttgcccccgacattcgtccggatggggacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatgtcagaagatttcaatctttttgctacgggagaatgatgatggcggcgatggtcgtgatgataagtccggccgcaacagggataaagtttttcctggcaagctcaaacgggtcaactttacaaatagccgcagcgggaatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaaccctgacccgtcgagcccggtaatcgcaccgactgcggccagggcgatgccggcgaattctccggacatcggaaaagaatgggacagggccagtccgaggtcattgacgattcccgcagaccctttcggcagcggggtgttcaaaatatttttaaaccccgcgtcaccgagataaaagaaggccgcgatcggaatgacggggccgaatactttaaagccgaattgaaaaccgccgataaaatactcggtgatcttttctaaatgccgctctttatatacaatgaaatgaatgatcaggagaatgccgatcgcggttcctccgacgagtgccgtcgcatcgtttccttggaggcggtatacgatcatgcagataatatcggcgagaaaaacaagcggaatgaaaaccgccaggatcaccctgagttttttcggcagatacatacttgtgtccaaagaaccggagctgtccaaggagaggggggccttcgttttttttcgatcccgcatgatgaggaagaaagcggtgattgtcgtcgttaaccccatgatcaaaacgagcggaatacttgcctgcatgacatcgctcactgggatgcccgcggcatcggccgttaatttcggggccgcctgaatgacgtaatcgcccgataaagcgaatccgtggccgaacaggttcatcgccatagccgcagcgatcggagaaaggcccgcccggatcgctgcgggaagcagcacagcgccgatcagcgccaccccgggtgacggccagaaaaaaagagagatggcaaacatcagacagccgataacccaatacgcgacagccggccctttcatcagctttgcaaacggagaaatcatcgcttcattaataccggttttggtcaaaaggccgctcatcgccacgataaaacaaatgataaaaatcgtcggcagcaattctccggcggcatacgtaaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacagggtattcataggcgggcggaaggtgcaaagaaggatgcgtaaaatcgggacatcaaaaaagccggagaatctccggcggttttcagtctattgcgtaataagcggttacataagacggacgggaaaaaatagacgtcgtgtcgataccggcagatgttccgcgttttttatgagcttcctgataagagtttgactgctgccaatcctgaaaggctttttcctcttcccacagggtcaaaatgacatacgtatcgccttcgagcggtcttaatacgcggatggctttaaaaccgggttcattttccactttgccggcgcggtttttaaaccggttttcaaacagcggacggccttcctgggtaacggcgatgttgttgaggacggcgtagcccggatttttgatttccccgacgctgtcgatgctttcataggaatggggcgcctgaaaaacggtttctccatttgtttcatgaattaaaaccgcattatcctccccttgcatcagcaccatattctcactcgggtgtttcttggcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcacgcatcttcaaaaatcgtcgatcaagacggtgatgaaatcgcgagcctctatacggaaaatcgtgagccggtatccattcagcaggttccggaagatgtgagagatgcctttatcgccgttgaagataaacggttttacgaacatcacggcattgatgtgaagtctgtcggccgggcggtgttccgggatgttttagcaggcggcaaggtggagggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcagaaggagccgttctggcagcgattccgaaggcgccatctctttattcgccgattcagcatccagataaaaataaagaacggcgcgatacgattcttgcaatgatgaacgatcaaggctatatcagcgccaaggaagccgtcagagcccagggccggacattggggcttaatgtcaagaaaacatcagaaacgccttggtttgacagttatatcgatcttgtcatcaaggaggcggaagaccgttattcgatgtcaggagaacagctgcttcaaggcggctatacgatccggacgtcacttgattccaagctgcagaaaacggcatataccctcatgaaggaaagcggctattttccggggacggatcaggcggcagagggaagcgccgtctttattgataataaaaccggaggcgtgcgcgcggcggtcggcgggcgcgactacgtgacaaaaggatacaacagggttacggcgaagcggcagccgggctcaacgtttaagccgattgccgtatacgggcccgccatgcaggaagacaagttcaaaccgtattcgcttctccaagacaaactcacgtcctacgacgggtatgaaccgaaaaattatgacggacagtacaagggggaagtgacgatgcaggatgcgatcacttacagcataaatgcgcccgctgtctggacattgaagcagatcggcgtggatacgggaaaatcgtatcttgagaaaaacggcatgaacatttctgacaacggactcgcgattgcgctgggcggtctgtctgaaggcgtcactccgcttcagcttgccggagcttatcatacctttgcggcaaacggaatgtatacgaagccattttttatagagaacatcacggacgaagacggagaaacgctatccgggcctaaaaatggcaaaacgcgcgtcttcagcggacagacggcatggaatatgacgagaatgcttcagcaggtcgtaaaagaaggaaccgcttcacaaggcagctatcaaggcgacctggcggggaaaaccggcacgaccacatttaccggcatccccggcgcgacaaaggacgcctggtttgcgggatacactcccggactgacgggagccgtctggatgggctatgacaaaacggataaaacccattacctgaaaggcggcagccaatacccggtcagactttttaaagatatcgtcacaaaagcgggtgaaaacggccggacattcaaaaagcctgaaaatgtgaaggaactgggcagcccgattgagctggaggcggtaaaatccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatttaattcgcagacgaatcaagaaggagagggaacggaatacgttcagccgaagcttttttcttcttaatcatgaattcggcgattttttgaacattaagcctcaattctataccattcagaaaaaacaaggtatagtgtaatgggcgaagaacacgaacgtatggttgcaggaggaaaggtggaaattcagatgagtaaacgagaagcgtttaatgatacgtttttaaaagcggcacggggagaaaaaacaaatcacgtccctgtctggtacatgagacaggcggggaggtctcagccggaataccgcaagctgaaagaaaagtacggcttagtcgaaattacgcatcagcccgagctgtgcgcgtatgtgacgaggctcccggtcgagcagtacggagtggacgctgccattttatataaagatattatgacgcctcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgtaaaagcgcagattcatgccggcgcaaaagccattcagatttttgattcatgggtcggcgcgctgaaccgcgaagattaccggcagtttataaaaccggtgatggacagaatattccgggagctttcagcagagcaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaaacggacgggtttattttcaatttaggtcacggcgtattccctgatgtcaatccggcaacgctgaaaaagctgacggcgtttgtacatgaatattccgcggccaaaaaaacggaacaatcttcctgagcagatcgttggttataagaagattttcctgtcaaaatcaaggtagacagaccatcaaaagaggtgtttaacaaaatgagcagcaaaaagaaaatgggacttctcgtcatggcttacggaacgccttacaaagaagaggacatagaacgttattatacacatatcagacgcggaagaaagccggagccgcacatgcttcaagacttaaaagacagatatgaagcgatcggaggcatttcgccgctggcaaaaatcacgcaggagcaggcggagaagctcgcacagcgtttaaatgaaatccaggacgacgtaacattcaaagtgtacatcggattaaaacatattgaaccgtttattgaagacgcggtggcggacatgcataaagacggcattacagaagctgtcagccttgtgctcgcccctcatttttcaacattcagcgtccagtcatacaacaaacgcgcgaaagaagaagcggagaagctcggcggcttgaccatcaagtctgttgaaagctggtatgatgaaccgaaattcgttgattattgggtcggccaggtgaaaaaaacgtatgagtcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgattacgcagtcggctggcaaagcgaagggaacacccctgatccgtggctcgggccggatgtgcaggatctcacgcgcgagctgtatcaaaagcatccttataaagcatttgtatacgtgcccgcaggcttcgttgccgatcatttagaggtgctttacgataatgattatgaatgcaaagctgtgaccgaagaagtcggcgcaagctactatcgtccggccatgccgaacgcacagcctgaatttatcgacgcgcttgcagcggtcgtgctgaaagagctggacaaatagaattaaacggtaaagaaggcgataaaaatgagtggcgataaaaaacatctggtcatcatcggcggcggcataacgggattagccgccgccttctacatggaaaaagaaatcaaggaaaaacagctgccgcttgaggtcaccctgatcgaagcgggcccgagagcgggcggcaaaattcagacggcgcataaagacggctacatcattgagcgggggccggattcttttttggaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgccccgttcatctccaccggtttattttctgttcccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaaacacagaagcctgattctcggtatgaaaaaatcacgtccgcagccttcgggacagcagctgacggccaaaaagcagggccagtttttaacgctgacgacagggcttcaaacgttggtggaggagctggaaaagcagcttacgctgacaaaggtgatgaaaggaacgaaagtcacccatatcggccgcgaggagaaaggatattccgtgacgcttgataacggcaaagtgctctatgcggaaggatgcatagtgacagccccgcataaagccgcggcgaaaatgctttctgatctgccggcggtttcatgtctcaaagacatgcattctacgtccgttgccaacgtcgccttaggttttcctgagggagccgtcaaaatggagcatgaaggtacgggattcgttatctcaagaaacagcgatttctccatcacggcctgcacatggacgaataaaaaatggccgcacgcggcgccggagggcaaaacacttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaacgaaagcatgccgcaataccatgtcggccataaggagcgcatcaaagagttcagagatgcgctgaaagcttcctatccgggcgtatacgcgacgggcgcgtctttcgaaggggtaggcatccccgactgtatcgaccagggaaaagccgccgtatatgattcactcgcttatttatttgaaacgtaccagcctccgttatcgtaaaacggaggttttttgcatgttcccgttctgtaaagggaacaccaataaagagaaaaaacatttgaatcttctttgcgactgtgataagttatcttatgtacaaaatgactaaaacgttcaaacggtcaatttaacgaggtggggaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgttcaccgggcgcttgtcgcgattttggaattcagaaaaacacaccagctgactattaaaatttttcaggagaacgccgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaaacgatcttgatcaatcgttaaaggacttattaaatgctaaatattatttattggtcgagattcctgaagatttttctaaaaacgccagcacggtaatggataaaaatccgaagaagctggatctgaaatatcatacgaatgccggatcaaactatgtcggcgcgacaatcggagaaaaggcgatcgacaagctgaaagcctccgtgtcgaaagaagtgacggagcaatacgcaaaagtcatttttgacaattttaaagatattgccaaaggactcggcaaagccagcagcggcgccaagaaaatagacgacggcacgaaaaacgcgaaagacggcagcgccaagctgaaggaaaatttagcgaagcttactgaaagcaccgccaccatcggcgataaaacgcagcagcttgcagacggagcggcgaaagtgacaagcggaattcaaacgcttgacagctctatcgcaaaacttcagagcgcaagcgccgaaattcaagataaatcaggacagattgcttcaggaggaggccaagtggccagcgggctgaaaacgagccttgacgcacaaaagcagctccagcaaaagcttccggatttaacgaatggattaagcgcgttaaacagcaaggcgcaggaagtgtcgcaaaaagcggcggcatttgaagatgcgatcaattcagtcaacctctcagatattgaaaaagcggttggcgagcttgagcagactgaaaaggaattgcagcagtttaagaaaaagctttctgatctgaaaaacagcctggatgcccgggatgacgcggtcaaaaaggtgattaaggacagtgatttcttaacggatgagcaaaaagcgaaacttgttcagcttctgaatgagaagcttccgaaggccgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggctggaactgataaattgtacagcggagcgcagaccgtctttgaaagccaaaacaaattgacggccggtatcggcgaatacaacagcaagttcggacagctcaaaacaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccggacaattgtccagccagctgaaagatgcggctgatcaaaccggggacattaagacggatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctcagcaaattcagcgtcattctgctcgtcggactgattcaatccgttatagtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctggtgctccagcttggggcaagcggaggaaccttcccgcttgaactcctgccgggattctatcaagtgattcacggggcactgccgatgacttacagcatcaacgggttccgtgccgtcatttcaaatggcgattacggctatatgtggcagcaggcatccattctgttgggcatcgccgttgtcatgatcgcgctgaccatcgtgtattttacggtgcaaagcaaaaaagaacacaaaacggaagaagaaataacagcataagaaaaagaggcgctgagcagatgctcagggcctcttttttttgatttcgattaaaatccccatctcaccaaaagtccggtatacgtcaatccgccgccgaacccgaacaataccagcgtctggccttccgacagtttttttgctttcacagcttcatccaaagcgagaataatagaaaccgatgaagtgttgccgtaatattcaacgcttgtcaatgtccgttcaagcgggaagggcagtttttcacagatggattcgatcatccgcatgttggcgctgtgaggaacgaaccaatccagatcgtcttttgaaaagccggctttttctaaaagggcattgcattcctcaggcacggttctggccgcccatttatatacttcgcgcccgttttgcaccatatttcctccgcctttaagcggctcgccgtttaattctgcgctcagtcccgtgcgatacagcacgtccgcgctgcctcccgctgttccttgcacggctgccaaaaagcccggcgctgattcgtcgcgttccaccaatagggcgcctgcagcatctccgaaaagaacgcaggtcgtccggtcagtataatccgttacctttgataatgtttcaccggcaatgacaatcactttttgatgggaaccggcggtaattaatgcgtctgcgagctgaaggccgtaagtgagtccggcgcatgtggcgttaatatcaagcgctcccgtgtgcggccagccgaagtaagcctgcacgcgtgccgcggtgcttggaaacgcatagtccgccgtcgttgtggcgacaagaatcatatcgacatcatcaagagttccgctgtatcgttctgcaaggtttttcaccgcttccacacacaaatccgatgtgaattcatgttcgccggcaatgcgtctttccttcataccggtgcgctggacgatccattcatcagatgtatcgacgatgcgctccaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaattttatttgtaaaacgggcttgtgtgaacgattaccaatgacggcagcagcggcggcatgaatgatgatgcttctttttgtctttcttctttttgtctttcttctttttacaagggtcttcttttttctttttacagtgatctttttcttttttacagcaccagaaggctgcaccagaccaatcatcctcaaaccaatcctcaaaccaatcattatgaaaccttttccgcttgtgcggtttacggctgatcatacatttccctcctatgctcatgctcccttcattctatgaaaaaagagcaggaaaagattggacgggttatggatcaaaagagtatattttaagaagaataaaattgataggaggaatgacctgtggaaaatatgaaacatacgatggaactgattaaagaactggtgtcgattccgagtccgacgggcaatacatacgaggttatcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggaaataaagtcggacggccggctgaagattgacttgatcggcggcttccgatatcactcgattgaaggggaatattgcgagatccaaacttcttccggcaaaacctatacaggcaccatcttaatgcatcagacttcagtgcacgtctacaaggacgccggcaaggcagagcggaatcaggagaatatggaagtccgccttgatgagcctgtccggacgaaggaagagacgtccgatctcggcatcagggtcggcgatttcatctcatttgacccgcgcgtgcagattacgccgagcggctttattaagtcccggcatcttgatgacaaagcgagcgtggctctgctcttgaatttaatccgccgcatcacggaagagaaaatcgaacttccgtatacgacgcattttctgatttctaataatgaagaaatcggctacggcggcaattccaacattcctcctgagaccgtcgaatacttggctgttgatatgggagcgatcggcgacggccagtctacggatgaatataccgtctccatttgcgtgaaggatgcgagcggaccgtaccattatcagctcagaaaacatctggccgggcttgcggagcgctatggcattgattatcagcttgatatttatccgtattacggttctgatgcctcagcagccatccgttcgggccatgacatcgttcacgggctgatcggcccgggaattgacgcttcacacgcttttgaacgcacgcatgaattatcgcttcttaatacggcgaagcttttgcaccggtacgttctatcgccgatggcataaaaaaccctgcgcggaaatcattccgtgcagggttttcattttaacctgaaatggttgtgttttgttctgttttggcgaggctcatgaccttcgcgcctttaacgggatcatactggccttcccattttgacatcacaacggatgccagcgcgtttccggtcagattgacgaccgtacgggccatgtccataatccggtcaacaccggcgatgaatgcaaggccttctgcaggaatgttgaatgcgcctaatgtcgcaagcaggacgacgaaagaagtcccgggcacggcagccattcctttggaagtgaccatcaagacaagcacaagggtaatctgctgccaaatggacaagtcaatgtggtatacctgagcgaggaataaagcggcgatagattggtacagcacagatccgtctaagttaaaggtatatccgatcggcacaacaaaggaaacaatacctttcggacagccgattttctccattttttccataacgcgggggagtacggtttcggagcttgacgtactgaacgctaataaaatttcatccttcatataggcgaggaatttgaaaatgtttactccggcaagctttccgacgattccgaatacaacaatgagaaagaaagccaaagctacatacactaaaccgaccagtttaccgagtgaaagcagggaactgagcccaaatttggaaacggtaacaccaatcaacgcaaaaacaccaaacggcgcaactttcatgacgaggttcacaacatggaacatcgcatgagaaacaccttcaaagaaggccaagacaggctttcctttttcaccgattgccgagatgccgagtgcaaacagcacggtaaagcagatgatggcaagcagatctccttcggctaatgattggaagaagtttgtcggtacgatatgcaggaatgtgtctgcgatagatttgttattttgttctttttctgtttcaacatattgactgatatctgtcttttgagcttcatgtatattaacgcctgttcccggatgaaacagattcgccaaagccagcccgagaataatggcaaaagtggtaatgatctcaaaatacaaaatcgttttgaagcctaattttccgacttgttttccgcttcccgcgccggcaacgccgatgattaagctggagacgacaattggaatcactatcattttgattaagcgtaaaaacaaatcgccgataggctgtaaatatgttggaatggcgggattgccgtaccagatgacaccgactacaacccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatcttttaaaacgtacagataattgctaataatggtgaataacgccctattcagaaagtatgatgacggctgaaaaaaacgggcgccgcacaacttagaattgtgcggcgccctattgtcacatatccttaattttcaagcagtcattgcacagattaatgtgacactcatactgctcaacaatctcatttccgcattcttcgcatttcttaccgggtaaatttctgaaaaaatccgacatcttttccaacatacccatccctctttcattgttttgtctctacattgtattataacagttttggaaaatcaacggctgttttggcacaatgtttaaaacatgcaatttgtacgaaaaataggtatattggaggaaaggatctttttatcataaacattcggagggtcatatgaaagttacagttattggatgctgcggcgggtttccggccgcaaacgaagcaacttcaggctatctgtttcagtccggcggctattctctgctcgtcgattgcggaagcgccgtattatcaaagctgtttgcctatgttccggcagaagagcttgatgccgtcattttgtcccattatcaccatgatcacatcgctgatatcgggccgcttcaatttgccaaacaggtcggctcctttctcggaaaagggacgcatgcactgccgatttacgggcatgatgctgatatagaacagtttgagcgtcttacatataaaacgcatacgaaaggagtggcctatcagccggaccgcccgctttctgccgggccgttcaccattaccttcctgaaaacggtgcatccggtcacttgttatgcgatgcggattactgacggttcagcttctgttgtgtatacggctgattcaagctaccaggacgcgtttatcccgtttgcggaaaatgccgatctgctgatctgcgagtgcaatttttacgcggaccaggacggcacgtcagccggccatatgaacagtttggaagccggacgtatcgcggaggaggccggagcgggggagctgattctcacacatctgcctcatttcggcgagcaccggaagctgaaagaagaagcggaatccgtgttcgggggcgaagtgacaatcgccgcttccggattgaagtgggagaaataaaggaggagcaccatgttatttatcgacaaccaaaacataaccgacccgaggatcaacctcgcaatcgaggaatattgcgtgaaacatctcgaccctgaacagacatacctgctgttttacgtcaatcagccgtcgattatcatcgggaagaaccaaaacacaatagaagaaatcaatacgaaatacgtagaagataacggaatcatcgtcgtccgcaggctgtcaggaggcggcgcggtttaccatgacctcgggaatctgaatttcagttttatcaccaaggatgacggcgacagcttccacaattttaaaaaattcaccgaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttgaaagtgaaaaaagacaaaatcgaatcaaaaggcattaagtcaatcagaagccgtgtcgccaatatcagcgagtttcttgatgacaaaatgacggcggacgaattcaaaaagcatctgcttcaccatatttttaatacaaatgatctttccgaagtgccggaatataaactgaccgatgaagactggaaagcgatccggaagatttccgaagagcgctatcaaaactgggactggaatttcggaaggtcgcccgcattcaaccttcagcattcgaaacgttatccggtcggatcgattgatctgcgtcttgaagtgaaaaaaggaatcattcaggactgcaaaattttcggtgatttcttcggtgcgaaagatgtgagtgaagtcgaacaggcgctgaccggaaaacagtatgacagaaccgctatcagggaggcgctggccggaatcgatctgaaacagtatttcggcaaaatagagctggaagatttcctcgagctgatttattagaacatttgccgaacgcatgatttgaatcagcgcccgtttttgtgaaatgatagaaccataatgaatggggagggatcatgatgaaagtatttctcatcggagcaaacgggcagatcggacagcgtctgaccgggctgtttcaaaaagacggcacgcatacgctgcgggcgatggtccggaaagaagagcagaaagaagcgcttcaagccgcgggaacagaagccgttcttgcagatttggaaggaagcacggaagacatcgcgaaagccgctgaaggctgtgacgcgattgtatttaccgccggatcaggaggaagcaccggatacgataagacgcttctgattgatcttgacggagcggcgaaagcgatagaagcggcaaagaaggccggcatcaagcggttcattatggtaagcgcccttcaggctcataaccgcgacaattggaatgaagcgctgaagccgtattatgccgcaaagcattatgcggataaaattcttgaagcgagcggtctgacgtatacgattatccggccgggcgggttattaaatgatcccggcacgggaaatatcaaagccgcagccgatttagaaagaggctccatttcaagagacgatgtcgccaagaccgttatcgcatcccttgatgaaccgaatacgtatgaaaaagcgttcgatctgacagcgggcggcacgccggtcagtgaagcgctgaaacaattatagtttccggttttacggcactcggggctttttgcccttgagtgtttttctatatttttctataataaaagtgaacgtttattccggataaatgaatgactattcattcattatatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgctgctgctcggaaatacgcctgactttgttattgcgtttttcggcgcgttaaaagcgggaattgtcgtcatacctgttaatccggcatacacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgctccgcccggcggagcgcagcagaacttatccgacattgtccaaagacgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcactgccgatgtttcacgttttttgtttaaccgtttgtatgaatgcgcctctgatgagcggagcgtgtgtcttaatcgagccgcaattcagcccggcctctgtgtttaaactgattaaaagccgtcaggcaaccatttttgccggcgttccgacgatgtataactatctgtatcaatacgagcacggcaaggcggaggattttgcgtccgtcagactgtgcatttcaggcggggcctccatgccggtcgctctgttgcagacgtttgaacaaacctttgacgtcaccattctggaggggtacggactttctgaagcgtctccggttacttgttttaatccgtttgaccgggggagaaagcccggctcgatcgggacgaatattttacatgtcgaaaataaagtcgtcgatacgctcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaagcgcgacgaagacggttatttttatatcgtcgacagaaaaaaagatatgattctcgtcggcggatacaatgtctatccgcgcgaagtagaagaagtgctctacagccatgagggcattaaagaagccgtggtcatcggcgttcctgacgccaaaacgggggaagcggtgcatgcttatatagtgcctgcggacggtgagctgacagagcaggcggttttcgattactgtgaaacacatttggcaaaatataagcggccggcggaagtggtttttcttgatgagattccgaagaacgcgaccgggaagctgctgagaagggcggtccgggacatgcttccgaaatgacggacgaaaagcgaagccgggggcttcgcttttacatgctgatccggtcagctctgcgattcttccttaatgatgctttgcacaagcttcgtatcatgccgggtcagtttgtaatacgtgtttttatacttgtacatcatataattgccgccttcgagccacatactgaatgaatcaaaacggtcttcatggtatttgaccgttccgtcgtaatcgggagacacgcttttggtcagtttgacttgttttccttggttcaagatatcgagcatatcttttacattctgcctgtctttaattttgatttctttttttccgtgctctgacagaataatcagatctgcgttgcttgatggaaacacatcgccggtccggctgtatacataaaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggacttgcctatgtgctgtacggcctttttttctattggtatttctttatgacaggagactccgccgtcccggaggccgtaaagggaacgaaagccgatccgtcctcgttcatggacccgggccgcctggcagccgctgaaaacttttcaaatgtaaaggattttttatttttcatcggagcgccgttagattggtttttattttttctgctgctcattacggggcttgcaaaaaaaataaagcattggctggaagcagcggtgcgctttcgggtgctgcaaatcgtaagcttcgtatttgtgatttcactcatcgttacggcggcttcgcttccgcttgagtggatcggatatcgggtttcgcttgcgtatcatatttcgacgcagacagcagcaagctggataagagaccatgtcattgatttctggatcagttttccgctgtttgccgtgtgtgtgcttgtgttttactggctgatcactaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtgtatgaagtaaatatgtcggagaaaacgaatgcgctgaatgcgtatgtgacgggcatcggttcgaataagcggatcgttttgtgggatacgacgcttaacaaactgaaggatcgggaaattttgttcattatggggcatgagatggggcactatgtgatgaagcacgtgtacatcggactggccgggtatctgctgctgtcattagccgggttttatatcattgacaagctttataagcggctgtccaaattcttcggccgaatgcttcatataaaggggcctgaagatctggccgccctcccgctgttatttatgctcatatccgttctcagttttgcttctgatccgattacgaacgccgtctcccggtatcaggaaaacgccgccgaccgttacggcatcgagctgaccggaaaccgggaagcggcgattgagacgtttcaggacttggccgatacgggactgagccgggtcaacccgccgtttctcgtcaaaattttcagagggagccacccgtcgatcatggagcggattgaacatgcggaggaagaaaaataataaaaaaaccggcggggccatggccgacgccggttttttatgttttactgagctgccgcctgtacgttgatcagcccttttccatagtagaaagcatcaccaagttttgtagtggtgttttctaaactgctgcggacttgagtgtttgtccagttcgggtgcttagaaagaatcaaagcagccgctccggcaacgtgcggagatgccattgacgtaccattgtacgcgccgtatttgtttccaggaagcgtactttggatagagacgcctggtgccatgacatcaagctcagaacctacgcttgagaaagatgctctttggttgctgctgttaacagcgcctaccgcaatgacagaagggtatttaccagggtagcccactgtgcttgagccgccggaagtgccttcgttaccggctgccgcaaccactacgacgccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagccgcaactgtaccggcaacgtgagttccgtgagagttgttatcttggaaaggatttgtttcagaaggaaccatgctggctccgcctgctacctttaaatcaggatgagaagaatcgataccgctgtcgataaccgctactttaacatttgatccggtgaagccttgagagtgcagagcaggggctttaatctgtgatacgccgtaaggcacggactgcgcgtacgcctgtgcaacgtgatcttcttcaacgtaagcgacgctagggtcttttttcagctcttttacagctttttcatttaatgtagctgaagctgcgtctacatatttgaattgcttttccactttcccgcctttttcagaaatgacatcttttttcttggcggcgctcatcgtgctcattgtctgcttaaatccgacaatatatttcttttccccgtttgatttccctgcagcctgggcagaagtcgtgctgccgaacgccatcgtaaagattaacgctaaagcaaacagcaaactgatccatacctttttgcctctcactctttatccactccttttttcatttgcagaataaccaatagacagattattctgtggattaattgtatagtatggaataatattttagtagacccaatttttttcagtttgttttatttctatttaggtatatcatctctctttcgtttaataggaacccgaaatatttaaattttaatggaaaaaaccgatggaaggacatgagtatttgtacacagccgcaatcgctttcttgtttactgggtcgaacggtttgattccatttttggaagctgaggcaaaaacaggataaatgtcaccttttgttgaatgcagaagtctgatggaaacgaaagcggaatgaaataaagcggccggcatgaatcagtctttggctttcttgacggagaaaagctgtgaaaccattttataaaaataatgataatgaatatcattgatacttatattgtcaatgatataattgcggaaaaacgaaagagggggaacagatgaaaccaattttcagtatgctgatgatcttatccgttctcttcataacggcatgctcagaacaggaacatgaaaccgccgtcaggcatgatctggggacggcgcatgtggctgcgcacccgcagcgcatcgccgtattgaatgagggctttattgacaccctccatgatctcggtataaagccggcggccgcggcggataaccggaaagagcgaaacgacggcagtccgtccgtcgggcccccgtcacatcccgatttgaaaaaaatcacttcgttaaagcccgatctcatcattgctgactcaagcctgcacagggggatataccatgagctgacaaagatcgctccgacaatcgctttgaaaaatgaagctgcggattatcaggatgcggttgatgctgcccttaccattgaaaaggcggtcggtaaagagggcatcatagagaaacaattgtcggctcaggaagaaaagctgaatgacatcaaaagaaagctggatgcagaaggcggcacgattttattaattgacgctgcaaatggcagcatttccgtaaaggatgaccggtttttcacatctcggcttatgacgctcgcagggtttacatatgcggtccagacggattccggcgggaaatcaggcgctatcaaaatgacgcccgggcagcttttgcatatcgatcctgattacatcgtactattggacggtgagaaagaactcgaaaaaaatcacctctggaaacagctgactgccgtaaaaaacggccgcgtttaccgcgcggacagggcggtatggacggagcgccggagcattgacggtgcggacgccgtattacatgatcttcagaaaaaaatgctcgccaaaaaggcccaaaactaattcgggcctttttgttatgattctgataggtggctgcttacattgtaatctttgacgcgccacttattttcaattcgttcgatattgctcaggcacgcattgacaagctttgcgttttgtatgccggtatcaccgtcagaaatagcggacaagagggcgtgaatggctgcgccgtgagcgacgatcagtactttttgatcaggaaaccgctcctgaactttcactaaaccggcaagcattctgtctgtcagctcttctgcggtctccatgttcgggtagtttttatccgggtagcgcttcgaccgttccggcaaagacattccttccgcatcaccgtagctccgttctctgaaatcttccatgacgacaatgggaagattcaaaaacccgttaataatgtcagctgtttttctggcccgtttcatcgggctcgagacgatgacatcccattcggacccctttaagtactctcctgtttctttcgcctgacgctctcccgtcgcatttaacggaatatccgatttgccttgaagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgcggctgctgcgtagcgggcatccgggcgtctttttgcttcataaaaaagccgggtgataagcgccgccccggaagccccgtacggatgcccgacggccagagcgccgccccggacatttattttagaatacggcacttgaagctgctgtgagaaaacgcatattttgacggcaaacgcctcgttgatttcgtatatatcaatatcatccggtgacaggtcccgttccttcaaaagctttttgacggcataaaccggagctgctgacggataatgcggatggacgccgcttaccgcgcttccgataaaacgcaatcccggctttaaaccgagagaccgcgctttttgttcttccatcacacaaactgccgccgccccgtcagaaattccgcagctgttggccgcggtgacagagcctccggactgaaagacgggtttggcgcgggcgatgagaggctccacgttccgctttttcagcatgttttcgtcagcggcgaatccgtgacaggggagaatttcccggcggtacaagccgtcttcgtgcgctttgacgctccgttcatagctgagaagggcatattcgtcctgcatctttctcgttacgccgtaagcctgtgccgtatactcggccgctatgcccatatcaggatcgccgatgtgttcaggagaaaagcgcgcccgggatgagaaaggggaacggctgctgctctccgctcctcccgcgatgtatgtgctccccgcgccggctttaacaaagtggcacgcgaccctcacggcgtccaatccggaaccgcactgcctgtcgatggtcgtaccggacacgctcaaaggaagcccggcggccaaggctgacagccgggcgaggttcccgccgcggcccgtcgcgtttccgatcaggacttcatcaatgtcttcgggcatgttccggctcaaatgtcggatcagcggagctgccaaatcttcggggagacagtcttttaacaggccgttttcccgggcgaaaatcgtccgcttcgcatccgtaattacagcttccattccatcatgtcctttgcctgcttttgtacggcggcacgggcgatctttccgccggctgtttccggtatttctgaaaacagccattttttcgggattttatatgccgccagctgctcgcggcactgtttcttcagttcctttacatttgcatgtccgtcgatcaccgcaacggcgatgctgccccaataatcatcaggaatgccgatgacggccgcttttctgacgcccggacagcggttgagcacacgttctatctcttccgggaatacattcaggccgcctgatacgatcatcccgttttcacgtccttcgatataaagatagccttcacgatcgatatatcccatgtcatcaaccgtcatccagccggaatcatcaggttttgcgccgttgatgtatccggaaaatttcatcgggctgttcacaaaaatcttccccgtttcgcccggcatgcagcgttctccgccgggccggcggatttcgattgtaacattttcaaacggacggcccgccgcgtcaggcttccggacgctgtcttcaggcgataagaacgccacgaaactcagctcagacgttccgtaaaaatcgtacaaccgtaaatggggatagcgctctgacagcgcttgtttagacgaagcgggccagtctgcaccggaagaaatcaccttgagcggtgtatccggaaacgcctctagtgagagcagggcgtccgtcattgtcggaacggtatatagaacgtcagcttgtctgagccggtctttcattccggccggattgaattttctttgaaggaggacggttccgccgataaacaaagtgctgacggcgccgtataaaaagtgtgacgagcgaagcgtgcccggtaccagcactttgtcatcaggggaaatgccgaactcacgtttcgtacaagaaaagctctccagccacgaacggtgagagcgggtgaaggctttcggcttaccggtcgatcccgaggtgaatccggtataaaagggcaggccggtgtttttgataaaagcgccttccgttttttccgcctcgatcaaaggcctgcattcatcccacaggatgacaggcgttttgatgccgtccagtctgccgctcagccggcggtcacagatgacgaggtcggttttgctgatgtgcagctggtccgcgagttccgccgcagccgagcggggatctaacggaaccgccgtgcagccggcatgcgccgcccctgcgaaaagttgtaaaaatgggatgccgttcggcagtaatatcgcaaggttttccggtttatctgaaaggctgccaagccagtttgcggtttggtttactagcctgttccaagtttgataggtgatctgttctgtttctgtctgaattgcgatctgttccggcgcttgtccggctgtatctgaatatgatgatgtaatcatggtgactaaaatcagcttcctttcgtcggcaaaagccggcttgcttgaagagtttttctgattcttacggctgcgaatgaggctgcggccgctttaagcagatctccgggcacatagatgaggctgagctttacggcagtcaagatatcaatgtgcattataaaagcctgaacgggaatgccgatgacatacaaaaacagcacgccgaacaagaactgtctgataaacaaatgggggacagcagctgagcgaaggccttggatgctgaggctcagcagtaatgccgccagcggatatgcgatgagatatccggcgctcggcccgaaaaaaaccccgaacccgcctcttccgcctgaaaggagaggcgctccgcatgccacaatcagcaaaaaaagcaattggcttaaaaatgccgctttcggtttcaagatgcttcctgataagagcacaccgatcgtctggagcgtaatcggaaccggcgtaaaggataagaaaagcggcggaagcagccccaaaagtcccataatggcggtaaacacggcaatatgcatcatttctgtcaatttcattatgtattcctccagcttatcaaaatatgtttatacaataaagcgagtctttatatatgtcaactctattatattttaagttaacattaaaaagaccggccttttattaaaaagaccggccttttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcgcttacaagtccgtttacatctttaatatgtttggacacgatgttgatttgtgtattggtattgttcacgagctctgatacggtggaaacagtttttttcgtatcctctgaaagcttccttacctccgtcgcgacaacggcgaaccctttgccatgctccccggctctcgcggattctattgaagcgttgagtgacaggagattcgtttgctcggcgatccccgtcacgatgccgaagattttttcgatctgctgggcgatgtcattcagcttgtccatttcttcttcaatctgcagaaggctggcgtcgattttattcatctgctgctgctggctttcaagctcttttttcccgccgattgatttttcttcgacatgtacggaagtgacggtgccggcttttgacgcctcggaaatgccctcagatttatcgaccagctcctgcacggctctgctcgtttctgaaaacaaatcagcgagtgatccggaagtttcctggattttctgatgaaggcgggctttcttttcctcttgttcgtcacgctggcagttatattcagtctggaatgcttcaaggacgagctgctgttcaagattcaatattttcgtcgtcgctttgatcgcttttaaaagctcatgcaaatccggaatggttgcttcatatatgttcatcatcgacagaagcagatcctgaaacgctcccatataccatttcggttcaaggccgatccgcaagtggatggaagcgatgcgctgtcttttttcaatgaattcatcatcaatcgtgccggcgaacatctcatggatatgacgccgtaatgtttttttcaggcgctcgaccgtgctgtggtcgttaatgatcgtcattaatgatttttcgtgatccaggtttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaatatgctgtttcttttttgcggtcttttttaaataacaatattagttcccccagatattctctttttctttttatcggtttggaaggaacttgaatgaaggaatctgataaaaatattttaatgcgtaaaaaaataaaaccattcgtacagaatggtttagtcaatcttgggtgagacgtttcagcggcttgatggcgggaccttcggcaaccccgccgtcgggtgtgaaccgggacccgtgacatggacagtcccacgtccgttcgccgtcattccattcaacctcacagcctaaatgggtgcatgtcgtatcgacaagatgcagacagcctttttcatctttataggcgccggcccgtttgccgtttaccgttacgatttttccctccccgggcccaagactctcaggcgaagcgtccggcctctcaagtttgcccgagataaggtgtttggccacgtcggcattataggaaatcagttttttcagtccgggatctgcgtggaagcgtgacggaataaacaggccggaaaacgggttctttttgttttgaatatgatcagccaaaagcttcgcggcgagcgctgagcttgtcatgccccattttttaaaaccggtcgccgccaaaatatgttcttcatcgcctgagatcggaccgatgaacggaattttgtcaatggtgacaaggtcttgtgcagaccaatgatatgggatgctttcaactccgattgtgtcttccgcaaattgtttcagcgcttcgtaatgcccggacatttcttttccttggcctgttttgtggctttcaccgccgacaagcaccagtttttcaccgtttaaatcggtgtatcgcagtgatctggacggcttgtctatgctgagatacatcccgtccggatacgcttgtttcggttttaccgcgagtacgtaggatctgctggcatacattctggcggcataaagcccgcctccgtcataaaaaggaaagtgggaagcgcagacaatgtagctgcacttgatgccgtgtctgtttttcgtgaccacttccggctgcggttctttttttatgtcgatcgcagccgtctgttcaaaaatccgcgccccgtttttaacgatctctttgacgagcgccgcaccatataaaagcggatggaattgcgcctgattcttcatggcgaggccgagcctgcaatcaacggggacgggaagatctttcacaagctcgtgttcaataccgagcttggtataagcttcctgctcactgcgcatttttttgacgcctgattctgtattggtgtaaagatatgcgtcttgttcaatcagtctgcagtcaatcgaaaggtccttgatgatctgcttcatgtcttccatggcgcggagatgggcttcgaaatacagccttgcgctggtcaggccgatctgctgaataagatcggcatagatgaaatcatgctgggcggtgatttttgcggtcgtgcccgcggtcgtcccgtttaaaatccggtctgcttcaatgacagcgacacggaaacctctttttgtcagttcgtatgccgttgtcaggcccgtaattcctccgccgatcaccgcaacgtcacattccgtatcttcagtgagggcgggaaaggaaggaatgtcagctgttgctttccaataggaagccggttcctcgtttgaaaaagtagtcaattcagatttacctcctctgttgtatattcttaatttttccaataagactctgttcatacatgaaattcgtataagatgctcaaattactcataatatagtaattaatgtaaaggagtgatcaaaatggcgaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcaaaggaaggcgctaatgtggtcatcgtttactttgatgagcatcaggatgccgaagagacgaagcaatatgtagaaaaagaaggggcgaagtgtctgctgatcgcaggggatgtcggcgacgaagccttttgcaacgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttgacgaaagccgcgctccctcacctgaaaagaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacttagcaagcgatgattctacctatgtcacgggacagacgattcatgtgaacggcggcaccatcgtaaacggataatgtaaaaaaagccaatccatatggattggcttattcactctgtttgagagcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttccgtgttgcgggacttcatgagctcagtgtacgactttttctctttcataaagaatccccccaatgccttttttatagtatatggataacggccggaaaaatcaattaatttttataatctttagacaactaatacttggaaatatatcgacatatcctgcaaattgacgaaaaaacgaaaatgatcattgtataaatgaggtgaaatgaaaaagaaaaataatatttaaatagtaatttaagactaaattacagctttaaaaggtgatttttagctatattcaaaaaaaacctgtcgttttccaatgacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcgggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagaaagctgtgatgtgaagggacgggccctttccttttgggaagggctttttcgatttacatgcccggatagagttgtatcgtgtccgtctgttggctatgatgatgtaaagagtaatgatatttcattttaggagagatgggcatggatgtgtttgcaaaatatgtatcagaaatcgataacccggatcaccgtctcaaagcagaagaaattttgtcgtggacggctgaccaatttccgaacttagaagcgcagatcaagtggaacaaaccgacatttaccgatcacggcacctatatcattatgtttgccgcggcaaaaaatcatttgagcattttacctgaaaaagagacgatggagcattttgccgatgacatcgcccaagccgggtacagcgcttcttcacgcctgttcagaattcggtggactgatccggtgcactatgatctgcttaagaagatcatcgaatttaacatcaaggaaaaagctgaaaatccggggttttggcgttagcggacgtgatgttgaaggaggaagacatggacgttttcaaagactatttatcaagtatcgacagccctgaccatcgtctgcgaatggaggaaatcctgtcgtggacgtctgagcaattcccgggtttaacaccgcagatcaagtggaacacgccgatgtttaccgatcacggcacctttattatcggctttgcggcagcaaagcatcatgtaagtgtttctcccgaagaagctggaattgcgcattttgccgacggcattgcccgtgccggctacagcgctacttcccgtttgttcagaattcaatggactgaaccggtgtattatgagctgcttgaacgcatgattcaatttaatatcaaggataaggcggactgctcagcgttttggcggaaataatgaaagaaatgttaaaaaaacaaccctgaggagggctgtttttttattaaacgtaatccgaaaaataagggatttgcgtatccggcagacccttacgaaacgcacgatgacagaaatcgtgcgttcaaaattctttatttgacgacagacatgctgacgctgcttcctgacactgtcaatttggcaaaatcctgtgtatcaatcacaggtgtgactgctttattgtcgatcgtgatgttcgtaaaggctgtcgagaagtttgatttgatgtaagggcgctgatcctctgatgtgaccgcgacggtggcgagcgctttccattttgagacagagcctacattggtttgggcgagttctgagatgatgcggccggtgtatccgtcattattcgtgccccaatatgtggcgcgggtattgccgttcagatttttgtaaatggtcagctgtacggtgctgccgggccggaagcctttcgtataagtgaattggctttctccttccagataccggacctggccttgtccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcagataggcccttccgccgattcctttactgagctgggacgccgcttccgccgtattgggactgatcacccccggaatatccgccgtacatgcgccgaatagaacggctgtagtgagaacacccgcaacaagcccttttttcatcatcatttctcctcctatcatcatagtcagatagcgctatcaattcatattataaaaggttttgggaaaaattccataaaagatatacgggcggacgtaaattaaaactattttcctatttatcttgtaaatggagattatttgaactatgatatgttcagtcatacaacatgattcaggaaaggggataggatagaaatgaaaaagacggcagctgtgcttttgtctttcggcctggtgttcggttgttcatacggagcggggcagacggcagaagcgaaaacaaaggtaaaaacgtatcaaaactgtaaggcgctgaataaggtgtataagggcggcgtggccaaatcgtcgaaagtgaaaaacaagggcggcagaacaaagtacaagccgtatgtatcaaaagcgctttataatgcaaataaaagacttgaccaggataaagactatatcgcatgtgagaaataaaaaaacaagcctctttaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcttccagcatttcggtatagcttttcaattcgccgccgacgacagattttaagcctgcaagcaaatcttttccgatgtgacgggactggacgatactgcttgtcaccaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgacggcaaacatgacggcaatgttcagaaccagcgcgatgatgcctgtattcatatccttaacgatctgcggaagaaacggaaagagggttccgacggttgattcggtcagcgtaatgaaggccactgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggaaatcagcgcgataacgggtacggcgtattttgcgagccgtgagactttttcgtcagtcgtgccgggcagaatggctttgtacacatttttggcgaacagcgtgcttgaggccattaatatcattgaaccgggtacaagcgccgtcaggatgcccgccgatccgatcagcccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccgggttttgcggcgtcaatttgtttgaacatctccgtaaacccgccgtaataatgaatgggcagataaatacctaaatacaggacgatgcctaaaatcatgatatctttgacgacggatatccacgctgaaccgtggattcctgaaatcatcacataaatcgtgatggagacagcgccgatccagacagcggcggagggcggaatctgtccgtatgacgttgctgaaacaattaatccgagccctttcagctgcaggacgagataggggatgagggatgcgatgccgacgagcgatacgagaatgccgaggagcgggctgttgtattttgaaatgaaaaaatctgattgcgacatcagtttgtgttgtttggcgtaagtccacacggctggcagaagccaatatgacaaaatgtaggcaaggcagccgtacgcgataatataaaaggccgggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcattcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaattttattttttgaaaaggaaaagcagtcccggctgctttttaaatggtcgcaagagacaggtaatattccaataaggcggttacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcggccgccatgggcagaaacagccctttttcgatgagatcgcgggagccgctccgaatgtcaggcataaatactccttctttcttaaaaaaagagaacgtttgttcttattttatactcgcttacacgatatttcaagacggaaaatcccgtaaacattttcgttttttggagataatgtgtagaataaggatagacaaactcgttaaggagtataaacgttggagcaatttttatcatatttgactgaggaacagctgacggaatggttccaaagctatagagctttcggcccggcggctgcggctgtattgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtaggggcgctgcagtttatatcagcagccgcgatggggaaaatggttatgatctttatgatcagttttatcgggtatgatcttcacgcactcattacacagcctttcaggatggcgggcgccataatggtgatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagcatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgaccggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtcaaaaagcggaggaaagactataatgaaaaatgttacgcgcgaaacaaaaaaggaggcgttttatttttcatatttttgttacgcgcgcaacaaaaatatgaaagagggctgatgaaatgaaaacacaggctgccattatcgggggaggtccggtcgggcttatgcttgcatcagaactggcgctggccggagtgaaaacgattgtcattgaacgattgaagaagacggtgccgtattccaaagcgcttatcatgcatccgcgcacacttgagctttttgccatgagaggcatattggaacgcttcttggaaaaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggagcggggagcattgtccggaaacaggcgggcatcgctttttcgggcactgatgccgacttaacaggaaccctttgtgatgccgctttgaaacatccgcccgaatcttcctttttttcaacgtgccggctggagggatcggttgtgattatccctcttacggacggacttttccgcgtcctcatcgtttctccgcacgtcccgcaaaagcggaaggaagagcgggtcaccgaagatgagctgaaagaagacctgcggcggatatgcggcactgatttcggattgagtgatccggtatggatgtcgcggttcggcaatgccgagcgtcaggctgagcagtaccgctccggccggatttttgtggccggggatgcggcgcacattcattttcccgcaggcggccaaggcctgaatacggggcttcaggatgccgtcaatctcggctggaagctggcggcgcaaatgaagggaaaagcggcgcctcatcttctggacagctatcatcaggaaaggcacagcacaggaaaagaagtgctgcacaatatcaaaacgcagataaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcataccctgaacggaaaacgcctgccggatatcgaactgacccttcatgacgggcggccggcccggctgtatgattttctccgcaagggcggctttgtgcttctgtcattaagagggagcattcccgccggtattgatacggacagcgtggcggcagtcagggcggagcttgctgaaacacgtgccgattggaatgacgtccacaccgttttaatccggccggacggccatgcggcatgggcagccggcggctcgggacgtgaagcggaagaagccgttctggccggtttggagagatggggattattcatctgataacctttttatgcgcctgtgtgattgtttcttatgtaacaaaacgttatagtaaaagaaacaatcaatacggaagggtgactcagcagttggacagaagacagccagaccatgcaaaacacatgattcttgaagggctgaccgatatttttcacgagcaggagaggtgtcaggaggatatcagggcgtcgttggccggacggatggatgaactccgcgaaggaaacgggaaaaaattacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggctttctgcgcagaacccggctgagtgacaataaaaaagaagtctatttccggctgactcctgccgggaaagagctacattcccttcatcatgaatatcatgaattgataaaacagcggctcttggcgtttttagaccgctatacagatgaagaactgttatttgctgaacggctgttccgtgatctgtcagcaaactggcggtctgtaaatggcggcggagagctgttcaaataaaaaacacgcatatggatgcgtgtttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtaatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaatccgacggtcagcactctcgtcacgccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcggggaatttcagccgttttgcgcctttacttgcaagccaggcagctaaaataaatccggccgttaacaagacgggaataaggcccggatgtgaagctcctgctgaaacggctccggctggtgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgatacccggcatggcggataaaccgcccggcgccgttcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcagtttctggccgagttcgatgccgaggatcatttgtcccgccgcaagccatctgcggtgaatccctcttctgtcaggcgccatgaacagccagcggggcctcgtcatggagaggatgcagccggcggcaagcgttccgagcatccaggcgatcgacatccctgtaagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacacaaaaaaagctccggagatgggtgagtgcaccctactccgaaacctcgcccgcttttcctttccacacaagcgtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaagatgatgcaggtgacagcgagcacgggcaaaaaccctgacatcaccgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcatacgccgacagcccgaatgccaaaacaaaaacgatgataaaggcgatcaagtagcttggatgaatcgactttttcaaatcttttaagaaggttgattctttggcgctttccatctgctttgcgcgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacggcgggcatgataaaagcggcactgatgccccccagcacccttgcgaaatataaaatggagacatgtgtgcccaatccgaaggtcagctcggataatgcgaacaaaaacagtccggcgagaatcatgatttttctgccgaaacggtcaacccatctccccgcaatgggagatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattctgtttatcagcgttgatcgacccgtgaataaacacggaaatggcttctttttgcaattcgattctttgctgaatggtatcgtttttatataacacatctaaaccgtagaagacggatagcaggatttttacttttgattcgacatgaggaatggaccagctgccgtcttgatttccctcttctaagatctctctcatcacatcgtcatattcaatatcaattttgttgagccgctttacgacctcctctgacgtaaacgcactcgcataaaactcttcacttgctctcataagcgggtaattgatgctcatccggctcagcagctccgcaaagcccgtcagcttttcggcagcatctttcagatcagcttccatttccctccacgtctcgatcatcacgcggtgatcctcttccatgatatgaagaaacagaaactcttttcctttaaaatggtgataaagattgcctttactgatctcggccgcctctaaaatatcccgaatcgatgtttctgaatatcctttttttgcaaataagtcacgcgaagcggatacgagcctgttcttcgtcttttcgctctttccggcaccgccttttgtatttgtcacttcacacagatcctttccgcctcattcatatcgttgtcccggcaaagcggggctcggttcgtttaaaaccgaccagttggtttattttattataaagggtttttgctgactatacaatgaagaagttatccattgtttagtggaagtataaaaacggctcgaaaaataaaccccattctctcctgttgaaagaacggggtttgccgtctatgactcccagcggggagcgtctgaatcgttattttccggtatttacctcggtgtagcttgtgttcggcgagtttgataccgttccccctgtatggtggaaaggagagtgggccatatcgtataaaaaccagacggcatgacgctgctcgtcaaatgccgtgcgggcaaataaccgtttcgcttcgggatgcaccgctctatcggatgcctgtaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacgacgtcttccggtttgaggtttctcttatccaattcttctctcagccatttttccgatacgtggttttcttccagatttttcattaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtatagcgcatctttttcatattatgctcaagtatttttccgttttgaatgataatggtcggtttgcctgcaaagaaacccctggcagttctgtttttcatagaaagatatgcgacaagataaatgataaccacaaaaatcgtgtaagcactgacagtaaaatgaatcggcagttttgtattaaacgacagattggctgtgatggcgccgagcgagatggccgcaatgaaatcaaaaagcgtcatctgtgaaatggtttgttttccgagtatacgggcgccgataaacagaatgctgaacgacagaatcgttcgcacaatcacttcgggatattctgacatcatatttaatcctttttttctttaatttggtcaaaaacgatatgttttaaaacagtcatcccgtttttaccagcagatgagattggtcattttcgtcaactttcgataaaatgtagaaagataaaaagagaggggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggcggcatgatacgcgctcaagtgttcagtttttcgcgtttggcgtggcgcgtgcttcagcataccgggggcatgaaccgtccgtttgtgacgacgacgggtgtgcagatgcttttaaggaaactgattgaagaacataagcacgattttaaagtgtatcaaaaagcgagtgacaaagccggattcactgagcaggtggaacggatgctgacagagtttaagcgatactgtattgagcctgaagacgtccgccgcatggcggaaagcggaacggcgtcagagtatcgcggagagcggatgctgtctgaaaaacttcatgacttaggcattttatatcagcagatggaaagaagcctcgccggacactatttgcattcggaggattatttgacgctgctcgctcagcagattcctttggcgcacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacttactataagctttatcagacggcaaaggaattgaatgccgatatttcctgcaaggaactgcatggcacgaagcggcatcggcatgtgccggagcttgcctgtatagagtcgcagtacgatgtgcgtcccgccgccgcgtataccggcggacaggaagcttttaccgtcatgcaggcgcaaaacagaagagctgagctcgaaggtattgcccgggaaattcaatcgcttgtccgggacggaggataccggtacaaagatatggcgattctcatccgtcagccggaagattataaagatttgctgaaggaagtgtttgccgattacgggcttccttattttattgacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggtagatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttatccggctgcagaaccggatgaaaaaagcgaaaacggttcaaagcatggcggaggctctttatctctttttggaagataccgatgttcccctgaagctggaccggaaaaggcagcgtgccgaagaggccggaaacatgatcgaagcgcagcagcacggccaggcgtgggatgccgttatccagcttctcgaggagtttgccggcatgatgggtgaagatgaaatatctttggcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcggtcggagtggagctgtcttccgcggggcgtgagcggctgcttgatgagcattttctcatctatatggcgctgtcgagtccgtctgaccgtctttatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccagcgtgcgaaaaagctgttttcaagcctatttttccgcaatgaggcgaagcgtcttgaacggcctgtttcgcgccagctttacggcgagcatattaaaggaagcgtttcccggatggaggcgtttaatgcctgccagttttctcattttgcatctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttttacgtgaaggaaaaactgcagaagatcgtcacgcgtgtttctggcatattaagcgagcatgcgaaggcgagcggtttcgtcccggtcggtcttgaactcggtttcggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgacagggggcttgatctggctgaggtgtattacgggctcgctctgcaaatgctcacatatcttgacttatcgattacacattctgcggattggctcggcatgaaagcgaccccggcaggcgttttgtatttccatatccatgatccgatgattcaggccagtctgccgatggggcttgatgaaatcgagcaggaaattttcaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccacgtgcggcggacatttgaacaggcgggcgaagcgataacggacgggcttgtgtccattaccccgtataagctgaaagataagacgccttgtacgtactgtgcgtttaaatcggtttgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttccggccgcgatattcttgtcgctgccgcagccggatcaggtaaaacggccgtgctcgtggaacggatgatcagaaagataaccgcggaggaagatcctgttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaatcgggcgagcatttcgacgcttcactctttctgtctgcaagtgcttaaaaaatattattatatgattgatcttgaccccggttttcgcatggctgaccagacggaaggcgaattgctcggagacgaagtgcttgatgagctgtttgaagatgaatacgcaaaagggaatcaggcgttttttgagcttgcagacagatatacgacagacaggcatgatctggatcttcaagaccttgtcaaacgggtgtacgagtattcccggtcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtaattttctggatgaccttcagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggagtctatcctgcagcttgtgaaaagcggggatgaagaggcgggaaatctgtttatggtaggcgacgttaaacaatcgatctaccgtttcagacttgctgagccgctgctgtttctcgggaaatataaaaggttcacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcagacagctccgaggatgccgaagactttgaaaccgtgcattgggaagcgaaagcgatagccggggagatccgaaagcttgtctcgtctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcttgtatgaccgggcgtgctcgtacgaagcgacggcgttccgcgggttattccgctttttgcggtttattgaacggatgcaggagcgcggcgatgatctggggaccgcccgtgcgctcagcgagcaggaggatgtcgttcggctgatgacgatccacagcagcaaaggacttgaatttcccgtcgttttcaccgccggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcttatccgaagaattgcgcgtattgtatgtggcgctgaccagagcgaaggaaaagctgtttctcgtcggttcctgcaaaaaccgggaaaaacagctggccaaatggcaggcgcaagcagaccgggctgattggcttctttctgaattcgaccgctatcaggcgtcatcttatttggactttatcgggccggcgctcatccgccaccgtgacatggaggcgcacaggacgccgggactttcttcgactgaggatatcttgcgcgacccgtcgcgttttcacatccggatgcttcagcaaagtgaattgctggaagagaatccaaaagaacgtgctgaagaaaagagcaaacgtctcaaggcgatacagcagggcgagccgattcctggttcgttttcatttgatgatcaggcgcgccgtctgcttaaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacgttccgactgccgaagaagcagagcggacggtccggatgctttacgaaaaagagctgctgacagaagagcagcaggaagccattgatatagaagaaattgtccggtttttcggaactgaaatcggtaaagaccttctcggggcgctgcggattgaccgggaagtgccgttcagtatggcgcttccggccggcgaggtgtacaaggatgccgaaacggccggtgaaccgctgctcgtgcaagggattattgactgcctctacgaaactgcggacggtctctatttgctggactataaaacagatcggatagaggggaaattccggaatggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcgggggatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcgggctgtgccggaacgatgccgtgaaaatcgcggcgagccacatttatgtcgcggggggaaatcagaccgattcagagcgtccgattgaagtcgggggcgcttacacggtcgccgctgacagcctgccggctgatgcggcttacgtggctctgggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgttctgccgcaaggaaagtttgccgagtttctgtcgcttaaaggcgcggaaagaagacatatgctccagcgcctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagctggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagcttgaggaaagacgcccgtacatcacggatttgactgagcgtcttaaagaggcggaaacagctctcgcccttgagccgtacgcagaccgctgcaccgaagccgtccgccggaagcagcgagccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagccattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgcagatgaacggaaaaaatgccagaccgcagcacagctggcggcaggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgaaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcacaagactgatcagcgcgcatcagcagacggtaaaacaagctgagcagcttgccgaacgaatccgctacgaggaaaaagaagccgaccgtctcagacattcattagaagagcttgaatcgctgtcagaaagccgattgaatcagtacaacgaagtctgcggtgatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcactgaatgacgcaaaaggccgggaatcagggagtctcatgtcactcagggatgctgaggcctcccttgagaaagcgcaaaacgactggcgcgtgaggtcacaagacaccgggtttaccgagccggaccaagttaaaaaaagtctgcttccgcaagggcgtgcagaggaaatgaaaaaagaaattgatgagtttctggacacctcaaaacagctatcggcaaatatcagccgtgttactgataaattagccgagcgccggatatcggaggaagaatggacagcatccgtttctctgctgaagcaggcagaggctgagtcaggcgccgccatggaggaaaaaggagcacaggcaaaagccttcgcggttatgcaaaaacagcataagcgctttaaagagattgaagccgaactgaaaagctggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgcttgccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggtacatgtgaattatgcggccgccatcatgtgaggctgacggagcaccacttaacgcctaaggaagaaggcgggacattccttccgaccgcaatgctctgcatcccttgtcataaacaggttcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgaccgacgtcgatccgatttgaaccacggacgctgacgataccccttgaactttcacattccttacccgaattgaaggattttcatggcagaatgcgctttggactcctgtttccggtaacggcatgacggccggctgccgaaagatctggtattcttttttgttaaatgagccttcatcatctctgtatacagcaagactgcgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccggtagaccggatgtcgccgacttcaatattccggttaatcactgtaaaaatcatgacggatcatcacctttcatttcaccaggtatgtgtttaataaagtgctcgacggccctgacaatatcacgcttcacatgttcggcaatctgctcggcatattgcgcgggcgccgtattttcttctttcgggacatgggacagataatactgaatccggctgtccatctgctttctgatatcttcaataatatgatatttgttcgtttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcgattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtgttgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgcctatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcgctttacagatgccgggtcttatacataaatgatacagatttatatacatatcacgtttatgagaaagcctcttttctttcgcggccgtgctgaatctgtgcggccgggttcggcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgcccggaggaagaatacataaaggaatgccatttaaaaatgatgggggattaacatgaaatttgcgacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagtttgtcgcgcatgccggacagcttgcggaatgggcgaaaaaaccgaatgacgagtcgggttcatttatgtatgcgctgtctgacgtaaagctttgcgcgcctattccgagaccttcaaagaacgtgatctgcatcgggaaaaattatcgtgatcatgccgttgaaatggggagtgagggggatataccggagcatcccatggtttttacgaaagccccggctgccgttacaggccacggagaaacagtgaagagccacttggacgtaacggagcagcttgattatgaaggggagcttgcggtaatcatatcaaaaagcggatcgcacatctccaaagaacatgcgcttgatcatatattcggctatacaattgtaaatgatatcacagcgcgcgatctgcagaaaaaacataaacagttttttatcggcaaaagcctcgatacgacatgcccgatgggcccggtcattgtacataagtcggccgtcagtgatccgcaaagcctgaaagttgaaacgcgggtgaacggagaactgcgccaatcaggatcaacgggtgacatgatttttccgatagctgaattaattgagacgctgtcaaaagggatgacgcttgaagccggtgacattatagcgacgggaacgccgtccggtgtcggaaaagggtttaagccgccgaaatttttaaagccgggggaccgcattgacattacaattgaaccgatcggcacgctgtcgaaccaaatcggataattgtgtgtctttcgcacgattgataatgctccgagcggcttgttgtggtaccataagtgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgccggaaaaatgctgctcggcatcattaccatcggactgatggaaatgctcgtcatccgcaagaaaaaaggcaaatcaaccggcggactgtggatcggttttattatcgtgctcgtcctgacggtgctgctcggccttcacttgccgatcggttttcacgtattttaatcaatcgcgcttgaaaaacccggatgcatccgggttttttttagttgcgcaactgggccgctgaatgagaaatgccgtgttgatgaggcgaaagagatgtgcaggatgccaaaagcgtcaatcactcttgttgccgcaaaagctacggctgtgatgggtaaaagcaaacgccggccgtcaatcagcgtgaaaaacaaagctgaatacatcaggcggcacctatttaaaaggtgccgcctgtttgttacgcggtgccgtcttgtcttgccgctgaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattataggaaaatacgcaatcatatacagacaggccgaacccgtgcagatggctgagaaacagcagaaacgtttcatcgtccagcgaatcgagcaaggttaacagcggccgtttgaccgccttttcataacggatttcttccccgccgagcagggggatggtgtctgcgccgatttcggccgaaccgccgcaaatccgtgccggctgccatctgccgtcgcgtttcatcaatacgtctgcgtttccgagactgtctgcaagcaggatatcgccttcatcgttttcgacgaggcagatgccgtcctctatcatcagtgtgccgcgcccccatttgtttttttctgagaaaagctgttttcgtttcataaccgtgcccgtctcctttgtttgtttcttctcttccgttctttccaaatcgggcttgtctcatacaactcttagtgggacaaatcaactatctgcgtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgaaagcggctcttcggggcaagagaccggctcggcgtcaagccgtttttttataaagaacacggctcttcctttctgtttgggtcggaattgaaagccattcttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgattcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataagtgcgtgattacgcaggatcagctggttgaacatctggaggaatccgttctcgtcagagacctgccgggcatggctgatgttgattcatcgctattatggttctgccgggaaattaaaaaagattttgtcgtgagcctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgacaaatctgctcgaccgcaaagaccgcatgagcatgggcgcaagtcttgaagtacgggtgccgttcgccgaccacaggcttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggtcacagaatggctgaaaacgattttacaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatacgaaacatgcgcccatcttgccgaggtgcactttcctttatataaacggactttctcattcctgccgccaaaaaacaggcgggccgcatgggcggtgcttgctttgtttcacgaagctgatcggcttgatatgcaggaacttgggggatttgaacaggcggcacaagactttctgaacggggcacgcgccgacggctttttgtgggaggcgctcactgatgtgcggcagcaatttgcgcttgaagaagagccgttgcgtgagtttatcgccggccacatctctgacagagaaaaagtaacgtatcaagagtttgatgacctgctgatgtacgcgggccaaacaggcggagccctcggcctgcttctgctgccggtttgcgcgcgccggaaccaagagaaactccgccatgcagccgtttcattaggagcagccattcagctgacccgggtgcttctgagggtccatacggatgagcggtcgaaaaagcgtctcccgcgccaggtgatgatgcaattcggctatacggaagaagagctggagagccataccgtcaacaaagcttttatgaatgtatgggagtacatcgcattcgaggccgaggcgtatttcgaggaggcgtctgaagagctggagctgtttccgttatactcaagacccgccgttaccggtttgctggcacattaccggtcagagctcggtgacatgagaaaacggctttcgcaagcataaaaaaacgcccggcttcttaacgaagctcggggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcagggctgcttgtgaaaattccgatcagctgctttgaaaacaaggtcatgatcaccgatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttgtaagacagctgttcgccggcagacggaatcccgattttcaggagtttccgcaagtgctctttatggacgtgaaaaatcttttgccatgtcagaccgagtccgatgcgttttttgacgatcacaatcatcgcgatgagcccgatgatccgcgcaaaggacgttgacatcgcaacaccggcgacgcctaacaccggaaggccgagcggcccgaaaatgacaagaaagtttccgccaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctaacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaatatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatatattctgctttctcccgggcttgaacattacggaacaaaaggcagtgaagaaacgacatcctattcgtggcttcattttgaaggagcggattatgaggtgacggaaaccaccgggaacaactggtcggagctgaggcgaaaaaaagggagctttgaagagccgtcccgctaccgcttgtccctgccgcaaaaagggaaggtgagacgcccgcagtttatggccgggcaattcagtgtgctgacagatgaaagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggctcttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatggtgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgccggtgtacttgggtttcatatcattatctgcagcaccgattatcagcctgaaaaagaaacgaagtatttttcgatgctgcggcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggttcgaccacgggtgaaagagacagaatcaaaggttttcaaaaagcgctgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgcgcggcgatacaggcggcgcgctcccggggcattcgggtgccggaagacttgtccgtcatcggctttgacaataccattctcgctgaaatgacggcaccgccgctcacgacgatttctcagcccatccgcgaaatggggcggcgtgtcgttgaacttctcattgatgagattcaagggaagaaaaaaacaaaaagcaaaatcattttatctccggaactcgtcatcaggcattctacggcaccagtaaaaacgcgccctcagcgataaggcgcgtttttttctgtgaaaaacattgtcaaacgagcgaaaagcattgtaaaattaaaacagcttttgagaaagcgcttgcgcaaatactgcggattgcaagcaaagaaagcaaacagcttgagttgtaaataaagcgctttcaaaataatgatttctgtttaataagagaaaccgcttgcgccattacggcatgcggcctcaagaaaaaaggagcggtgatagatgacagatcaagtcaggtgtgcggtgctgggattaggacgattagggtattttcatgcgaagcatttagccggcgaagtgcggggagccgagcttgcggccgtctgtgacccgatgaaggggaaggcggaagcgtgtgcgaaagaattaggaatcgccaaatggacggagaatccgtatgaactgctggaagatctcacgattgacgccgtcatcattgtcacgccgacaagcacacatgcggaaatgatcatgaaggcggctgaaaacggcaagcacatctttgttgaaaagccgctcaccctgagtcttgaggaatcgataaaagtcatgaaaaaaatcgaagaaacggacgtcatctgccaggtcggttttatgaggcggtttgatccggcatacgctgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcgagatatctcatgaatgccgaggttacgtctgtcagcgggcacgggaggattttaaagcacccgttcatggaggagtgcggcgatgtcgatcaggcattaacatatcttgagtttgattcgggcgcggccggcgatgtggaggcaagccgaaattctccgtacggccatgacatccgcgcggaaattatcgggacggagggaagcattttagtcggcacgctgcggaaaagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttaaaaatcgggatcgccgcgacggaatcttttaaaaccggaaggcctgtaaagcttaccccgggcgcccccggctatgccggattatgatagattcgaagtaaaaaagcaaaggcccggcatgcctttgcttttttatgattcatatgagaaaaaaatgtagtcagtcggcacgcctttatagcccatttggtgaagcatcgcgcttatattgccgcgatggtatgtgccgtgattcacaatatgccggatcacatcggcatatgtcgtccggagcgttcccatgcgcggatgagaaatggagatcgggcctttcgtgttctccatttctcttaaaaattcgctgtattctttgtccagttcagtcattctatgttcaatcgcctcaaaatctccgtcaagcttttcaaattgatcaaactgcgagacgatttgttcgtaagtttctccgtaaagcacgtgaagccaaatgtaatcagcccggcatatatgcacaagcacggcgttcaaagtcggaaaaacactatccagttcctgctgtaagcttgccgcgggcagggtcttcagatgctgaataacttgctcatttgcccatctatggtagtgatacagctttaaaatatctgacattccaattccccctcttccttccggtacattcaacatgacctggccgaattccttttatcgaaacaaaagcgccgcaaaataaaaagcagcaccccacatcactaatgccgagcattgattcaggatgccgaggagccggccgcctgtatccgccgtttcgtttaataaaagatcacgtcacgatggcgccgagcgcttctgcgaatgttacggcatgagacggagagatgcggcatcctttcagcttattaagcgagacatgcagatgatcaaatgtgcacgtgctgatatccatattaaaaagagacgtgccgatgaagtttgcgccgttcaaatcacagacgtcaagatctgtgtattcaagaacagcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagacatccgtaaaaacggtgtttctgaaaatgactttttcggcgcgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgttttcgcccctgcccacccttgccgaattgcgtgttgtttactgaacaaaggttaatatcaaagcgggatcgcgtcaatagcggcgcttataaaagcttcattccgtttgaacgtcatccggcacgccgaaagataacaaaacaaagcccttataagagatgccacgggcttttgtctgtttcaggcgagttctttatacatgatcacatgcgggccgatgccgggtatgtcaaaggggctgcccgtgcttttccagccgagcttttcgtaatatcccttcacgtgacatctggcgttgcaccagacaagcgccgcccccatatctgccagttttcgttccgcataggcgattaacgtgcttcccgctttttgcgtccggtattcttcaagcgttgccatgccgcgcagctggtaggcgggcgccgcctgtaaagcctgctggttcttcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccatgaaaaaatcctcctttgcttgattctttttctgtatcgtaccatgaaaaagccgcctgtcgtatcaggcggcatcttccgcgtcaatgcaaatatacatcagcccgcttttcatccttttgcttaatataagctgcaagttctgatgtcaaatcagaacggagaaacggggtgattaaataaattccgttaaacagttcgcacgccgtgtcgagaagcgacttggcgatggcgaggccttcggctttctgcttttgcttgtcttcgccggcgagcgccattttttcccggatgctgtctgacagcttaatgcccgggatttcatgatgaataaactctgcgttgcggctgctcgttaacggcataattccgatatacaccggtgttttgagatgtttcgtttcatgatgaatgtcaatgagctgctgctccgagtagacaggctgggacacgaagtagtcagctccgcactcgatttttttctccagccgttttaccgctttatcaagatggcggacattcggattaaatgctccggctacggaaaagttcgttttcttgccgagcggtttccctgataaagaaatgccctcgttgaattgtttaatcagcctgatcaagtcaaaggacgttaaatcatagacggaggtagcccccggaaagtcgccgatttttgaaggatcacccgtgatggctaaaatgtcggtgagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagtcgccgcttgcagaaatttgtcaaaattcaattttttcggcggatcaagctctacgataattgaccgtttttgagcggcgatttcgtttaaacccggctcggtccgttcattccggacggagatgacttcttcttcccgtctgattttcacttctttatcagtgacgggggaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagccggccttcttctaaagacgggaggctgctgttcggatagaccgataaataagtgtcacggaatatcggcacttcggtgagcgcttcaatcatgtggtacgggccgagccggcaattgattcccgttatgtcagcgccgagatcggcaattgacctgagggcttcccgaagcggcgttccgtcctgcagcacgccctgttcgtgcatggatacattcagcataatcggaagttccgtttcttttctcgctatcttcagcacttcgcgcgcctcttctaaatcatagtatgtttccaggagcagaccgtccggctcttcgtgaagcaataaataaagctgctcccgaaagctgcgtttaatctcctccaggctgtaggcgtttttgttaaatgtgcggatgccgcccatcgttcccaatacataagcgccgtctgaggaagcgcgcgcgattctgaccgcctcctgattgatttttttcgtttcatcctcaagtccgtatcttgagagcttaataaaattcgcgccgtacgtatttgtctggatgatgtctgccccggcttccacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactctgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatgtaattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgcgactttaccttcaagccggagtttttaatcaccgcgttgatttttttggcgctgtctttatcaatgccctgtacaagcttcgcgcgctggcgcaccgtgccccctgaggcattttcgattttgccgtattcaatgttttttgtcggcacgtcccgtttgatcagcttgccgctcagcacatctttgagctgattcagtttaaactcgtcatcagaaatcaggacaagttcttccttttctaaagttacatcgcttttagatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaaccgacggcgaggatacggttcttttacataacagtgaaattacagaggatattgaagacagagatgaagtggacgtatttatttacgtcgatcatcaggaaagactcgcggcgacgatgaaaaagccgctcatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgtcatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagcttctatgccctcatttgtttatcaccctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgagggggcggcggctgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcagacctggataatgtcacctccgtcacgtttaaagaggatgaaggaggcttcttagccggagcgctcgcggctatgacgagcaaaaccggcacgatcggatttatcggcggttcagatgccgacgtcattaaacggtttaagaaaggctacctgaaaggcgcggaatcagtcaaaccgaacatccgcgtgctgtcggaaatcagcggtacgtttgatgatgataagctcgggaagcgcatcgcccaaaacatgatccgaagaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacgcgctgttaaacgtccaggaagcaaaagccgaccttaatacgttaaaagaaagcatcaccggctattcctatacgctcgcagacgcccagaaagaagatgtacaaagctatatgaaaagcagctcggataaactggcggcgctcaaaaaaacgatgacggacgatgcggacaaagccgcttatgacaaactcgccaaaaaatacgaatcgtggcaggcggaggcggacgctgctcttgattcgaaaagcccggctgaagcgacaaggacggcggcccgcatcaacggtcttctgaatgatatttatatgctgaatctgaaaagccgggatcactatgaagacatgcagaagcagacggctgaccagattcagtttatcgtttacagcgcagccgtgctgaccatcgtgatacttgccgtcaccgtcatatcttccatcaggctgacgaagagaattgcagggccgatccgccgcatggctgaaaatgcccgtcgtattgcagcggggaatcttgccgttgaaatgcttgattataaagggaaggacgaactgaaagagctgaatgactcattcggaatgatggctgaacagctccgcaccttaattcaggcgatcggagaggtcggccgtgaagtcgagacttttgcggaaggtttgacgaaggaaaaccagacgctgaaggacatgaccgagcaggtgtctgtgtcgacggaagaaatggcgcaaggctcccaaaccatttcagaagatctgcagcatgcggtgcaattcattgaacaaatggatgaacattcaaaggcgaacgccgaacgttccaaacaaacgacgagaagcagcgaagagacgattgcggcggtggctgcggggcgaggtgctttagccgagaccaagcaagccattgataaaagcaatgagacatcaaaagagatttccgaagccgccgatctcttcatagagcatgcggcaggcatcagtatgatggcgcagaccgtttccgacattgcgggccagaccaatctgctgtccttaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtgctgcatcatgccgaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaacgatcaggtccgccggtttactttgtaacagacatccgtgcgcaaaaaacagccctctttcttctaagacaagagggctgttttgcttttacagatggtccggttttttggaattctggttttttcccgcctgccggtttttttcggcaagccggttctttttctgatttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatctctttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgcgcgagataggcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccagtgaagcgcatttggaatctacaatccgtaaatcaaaatcgggaaattcctcttttacttcattggcgatcattacggccgtctgataggtgccggaaagacctgaggaaaaggagatgtatatcgccggttctcccagttccgcgtattgtaaaaatactttttttatcgtatccggtgatgcctgggatgttttcggaactttcccttcccgcatcgcttgaaagatatgatccgcctgaatggtgaccgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtgatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcgaatgtatatgccagcggttttaccggtgtcgcccagctgctgtcaagcgtcgttgatcaatacgcccccttttatatttcgacaggagttctcatgttcctcttaaacattcccatcggtgtgttagggtggctgaaagtcggcagatcattcaccgtgtacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacattacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacatttttagggaagtccgatcagatcggaaaaagactgaaaacggtaaaaacatttgaagtaaaataaaaaagcggcgccctcatctcaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaaatcggcgattccgtccgcttcatttgaacccgtgacgcgatcggcggcctgtttgacttcatccgtgccgttttccatcgctacgccgcacccggcaaatcgaagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcggataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgataatggaagtacacatcatcaatgatctcagcgagcacattatgtatttggtaggtctctgtaagttcggcaagctgtctgaccacatcgacagataaagacgtgtggtatcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaaccgtatcaggcattccgtttttacatattgtaaaagaagaaaatcgggaccgtcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagcgcgcggtctgattgaagacgggcggatcggtcttgcggggacgtcaatgggcggaattacgacattcggcgcgatggccgcgtatgattgggtcaaagccggcgtcagtctgatgggaagtccgaactatacggcattttttcagcagcagattgaccacattcaaaagcaggacatcgacattgacgtcacaaaagaacaggtcgatgaactgtttgcgcggctcaaaccgttcgatctcagtctggaaccggaaaaactccgcagccgcccgctgctgttctggcacggtgttcaagacaaagtcgttccgtatgcaccgacccgcggattttatgaaacgattaaacctcattacagcagccggcccgaccatcttcagtttctgaaagacgaacgggctgatcataaagtcccgagatacgccgttttagaaaccgtcgcctggttcgataagcatttataaagcacaaaggtgttaacaaaagccgcttttacgttatactgaggaaaaaggagtgatggaacgtggaagaagcattaaaagaaaacatcatgggcgccttggagcaggttgttgaccctgagctcggcgtcgatatcgtcaatctcggccttgtatacgacgttgatatggatgacgacggcctgacgcacgttacgatgacactgacatcaatggggtgcccgctcgctccgatcatcgtcgacgaggtgaaaaaagcgctcgccgacattccggatgtaaaagagacggaggtccacatcgtctggaatccgccgtggacaagagacaaaatgtcacgctacgcaaaaatcgcattagggattcagtaataagaaaatgcaccccggattttaggtacatcctaaagtttggaggtgcttttcttttgtctgcatataagcgacagtgagggcttgttttggattgcaaacaaacctttatatataaaatttcatatgaggtttatcttttttgtaataggacagtctgtcctggagtgtacctgtgcggaattcaaatttatgtccatcgggatcagtaaaataaattgacttttgatcttgcttatctctaggacgcccatttaatatatttacatttagattttttaacctttgaagtattgcatcaaaatcttttgggtcaattgtaaaggccgtatgcgtataggatttatgtatttcatttcttggtatatccgcctctaagttaagtgcaagccaaagcccgttcagatcaaaatatgctgtcttttgccctttaaccagaagttgtgcatgaaatactttctcataaaattctatagatttttctaaatctgaaacagaaaaaagaagatgattgatcccttttatgttcattttccccacctcatttaacatctatgttttaaacaatccctttggtaatacatctgcatatatatccttatatactgactaaaaaatcatttttagggatttctgtgtattttttatgcctggtgttttccggatgaccgttttgaactgtactaaacatgattctgccggacgcgtctgctttgtcgctgcagaccggcgtgcggaaagaagggcaagtcactaaaaaaaacaagtttcccgccattcggggttttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtcagccgtctcatgcccgtgaaaattaagcagacggtcaaaggaaaagagaaagaaacattggtcgaaacgattaaggaagcaaagagaaagcatttgaagatctcaatcgcaggcgcccagcactcaatgggcggccagacgtattatgaagacggtatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggcgtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttgcacgatatgtatgtgactgattacacactctcagacaaccagaaagaattaaagcggcacaatgaactgaaagaagatgagcatccggcgctgacgaaattcgcgctcggcctctcccgccggtatgactggggaagaaattggttctggtcaacccagcagtcttattttctcagtcaaaacggcgtgaaagtctccaggaacaatgtcatgcggtcagaatcgaaatttttggaatatgaaaacacggacaacaccgacgtgcttcaagaatacttcgtgcccgtcggcgaatttgcaccgtacattcatgatttacgcaagacgctgtcacatgaagatctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtgcagcgcggattgtcagaaaaatgacggatacggcgttgcgccaccgcggcagctattatctgccgtatatgctgtatcaaacgaaagagcagatgcgcgaggcatatccgaaaagcgatatgttctttcagaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacacgcaattcggtctatcatacggcttgttcggcctgagcggcgcattgattcatccgctgctcggccggctgtcggcaagactggatccccgctggttcctgatggcgaattcgtgggggatggcggtgcttcttctgacgctcccgcacattaccggcgtgcaccaggtttatgtggtgcaggtgcttttgggcctgttcggcgccatgcaaaaacacggcgagaaaatcatgatcgccgattacactgacggcggggagcgggggaaaaaagtcggcagctatcatttctggacggccgtattttcagctgccgccattattctcggcgggtttctcgctgatttctttacggtttatattattttttacgccagctccgtgctgttttttataagcgggctgatgatgctgaaaaaaacaggctgatccgatcagcctgtttttcttatgaaaccccctcgatcgagagggggttttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatgcagaagattgtatattatattcatcgagcgacgaaggaaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggcgatctgcggattcaaaacccggccgtgtatgaaaagtggtataagcggaaggccgcgccgaaaggaacgattcaaagcgcggtttacggtttagccgaactgcaaaaagaagagattcagactgctaagctgattgccaatccgggatgttttccgacggctgtgctgctcgggctcgccccgctggcgaagaataagcttttacaagattcatttctgattgttgatgcgaaaacaggcgtatccggtgccggccgaaaagcatccatgggcactcattattctgagctgaatgataattttaaaatttataaggttaatgagcatcagcatactccggaaattgaacagcaattagcggcttggcagcccggcacaggcccgatcacgttttccgcacatttggcgccgatgacaaggggcattatggcgacgatatatacggaggctccccctggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgaaagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaaataaaaggcggcgtatcttcgccgaaagggtttgaggcaaagggcgtgcactgcggtctgcgctattcaaaaaaagatctcggagcgattatcagcgtagcgcctgcagtcagtgcggcggtatatacgcagagccattttcaggcagcgcccttgaaagtgacgcaagagagcttaaaaaaagagggcgtgcttcaggcggttatcgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagacatgaaaaaaattcaggcgggcattgaacagctcggtcaagcgccgtcagtgtccggagcatttgaagaagccattttgacgacggatacagtgacgaaacagacgtgttatgaactggtgatcggcggagacatcatcacgatcggcggagcggcgaaaggctccggcatgatccaccccaacatggcgacaatgctcggctttgtcacaacggacgcggccgtggaagaacagtcgctcaaaaacgcgatcagagagattacggatgtttcatttaaccaaatcaccgttgatggagaaacatcgacgaatgacatggtgcttgtgatggcgaacggctgcgcggggaatgattgcctgacggagcagcaccctgactggccggcatttaaaaaggggttaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagacgccaactgggggcgcatcatcggcgccatcgggcacagtgcggcaagcgtaacggccgaacaagtggaagttttcctcggcggtcagtgtctgtttaaacacaacgaacctcagccgttttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacatagcaaaggggagcggcatgaagaaaaccatcgtttttaagtgcggcggcagtgtaatccgcgagttatccgccgatttttttcaaagtgtaaaagagcttatgcaatcgggctggaaccttgccgtcgtgcatggaggaggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcgtcttaccttaatcaagacaaatacggagaagtcggcgaaatacaaaaaaccgatccgtcaatcatccacgcattaatgaaagaaggcatcattcccgttatcgctccgctttccatgacaagtgatttcgaaacgctgaacgtcaacgcagacgccgcggcatcggccgtcgcttcagccttacacgccgataaacttttatttgtcacggatgtcgaaggaattatggacggagagaacaggctggatactttgacgccgcaagaaattcaggccctcatcgatgacggcgtaatttcaggggggatgattccgaaggtaaactcggcattatcggcactgagtgaagatgtcgaggaagtgatgatcgtaaacggaaaaggagcgtttttcaccaatcaagtcttccaaggaacaaaaatcgttaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacggaagcggtgaaagaacagcttggcagcgtatggcacgtttccaatctgtttgaaaatgatcttcaggaaaaagccgcggcaaagcttgccggacatagcgcgggggatctcgttttcttctgcaacagcggagccgaagcgaatgaaggcgccattaagcttgcccgtaaagcaacgggaaagacaaaaatcgtaacatttcatcaatcctttcacggacggacctatgcggggatggccgccaccggacaagacaaaatcaagaccggtttcggaccgatgctccaaggctttcactatcttccgtttaatgacccgtcggcattcagcacactttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaaccggaatcggccggacgggcaaggcattcggctatgagcacttcggcatctctccggacatcatcactgctgcgaaagggcttggaaacggttttcccgtcggagccgtgatcggcaaaaagaagcttgccgacgcctttacgccgggtacgcatggtacgactttcggcggtaataagctcgccatggcagctgtgaaagcaactttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgcttccgccgcttacggtttctgaagaagaaatgctgtcggccgtcagtatgctgaaagcagcgatcgaagcgcattcggcagtgaaacggtaatttttttcgatataaaggtataaaaattcatatttttaattaattattcatcaagaggtgggctttagatgaaaggctatttagtattggaagacggaacatcattcggcggtgaacttgaaaaagaggcttgctgtgttggcgaagctgtttttttcaccggaatgacgggctatcaggaagtgcttacagacccgtcatataagggtcagatcatcgtctttacgtatccgctgatcggaaactacggaattaatgaaaaagaccttgaaagtaaaattccacaagtcaaggctgttgccgtctatgaagcgtgtgaacatttttctcaccatgaagcagtctcaagcttgagagagtatttaaataaatggaacatcccgctcttaaccgaagtggacacacgggccgtcgtcaaagccatccgctccggcggcacgatgaacgctgctgtgtcaacagcaggagaaattcccgcagcatccggaacacaaaacccggcggagctggcgcagtctgaagacatcacttcaatggggaacggagaccgtcatattgcgctgattgatttcggttataaaaaatcaatcgcctcgtcacttgtaaagcgcggctgtaaagtaacggtcattccgtatcagcagatggatgccgtttatgacattcagcctgacggaatcgtgctctcaaacggcccgggcgacccgaaagcgattgcgccgtacatgaaccggattacatctttactcagtgatttccctgcactcggcatttgcctcgggcatcagctgattgccctggctttcggaggaaatacgtataagctgccgttcggccacaggggtgccaaccatcccgtcattgaccggaaaacgaaaagggtgtttatgacaagccagaaccacagctatgtcgtcgatgaagcgtcaattgacgaaaacgagctgtccatcagatttcaccatgtcaatgatacatcagtggaagggctcattcataagcgccttcctgtattaagcgtccagttccaccctgaagctcatcccggtccggctgagagcgagtggatatttgatgaatttctagagaaagtgataccagcaaggagagaaatcgctcatgcctaaagatacaaccatttccagcatattagtcatcggctccggccccatcatcatcggccaggcggctgaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcattgaggccattattgaaaaagaaaaacccgacggtctgcttgccaatttgggcggccagacggcattgaatttagccgttaagcttgaagaagcaggcgtgctgaagaagcatcacgtcaagctcttaggaacatcggtggaaaccattcaaaaaggcgaagaccgggagcagttccgcgccctgatgaaagagctcgaccagcccgttccggaaagcgaaatcgtcgacaacgaagaagacgccctccgcttcgctgagtctatcggatttccggttattctgagaccggcgtacacattaggcggaaagggaggcggaatcgcgaaaacgaaagaatcgtttcagacgcttattaaacaggcgctgttagcaagcccgatcagccaatgcctcgtcgaaaaaagcatcgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcacagacgttaacggatgaagaatatcagatgctgcgttcagcaagcctggcgattatttcggcgctggatgtggtcggcggctgcaacattcaatttgcgctggatccgttcagcaaacagtactatgtcattgaagtgaacccgcgtgtcagccgttcatcggccctcgcgtcaaaagcgaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacgaagatgaaagcgacgggagaggtcatggcgatcgaaagaaatatggaagcggccattcaaaaagcggcggcctcccttgagctgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattagaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgttctgaccctgcaaaagctgggatatgaaacgattatgatcaataacaatccggaaacagtaagcacggattatgaaatcgccgaccggctttattttgaaccgctgacgacagaacatattttaaacgtggcggaacatgaaaacattgattttgccatcgtccagtttgggggacagaccgcgatcaatgccgctgaaccgcttgaaaaagcgggcattccgctgctcggaacatcctttgaaacccttgatgccctggaggatcgggatctgttttatcagctgcttgacgatcttgacctcaaacatgccaaaggcgaaacggcttattcaaaagaagaagcaacggaaaaagcaagccgaatcggctaccccgtgctgatccgtccgtcttatgtcatcggggggatgggcatgatcatcgttcattcagaagcgcaaatgtcagagctgctggaaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtgaaactggcttttaaaggcattatgaacattcagtttgtcattgatgacaaaggggatattctcgttcttgaagtgaatccccgggcaagccgcacggttcctgtcgtgtctaaggtgatgggggtgccgatgatcccgcttgccgccagattgctggccggcgcttcccttaaagacatcaagcccgaggttcaaaatcagcacggaacggcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatacgttcccggcatgggcagagcgaaaggataaagcggtccatattaatttcaatcactctgaagaagcgcgtaagcaacggatcgaagccatgacgcatggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcgggggaacgggactatttctttcaagcagcgacctgcagcttgggcggggggagacggtcgcggatacggcgaaggtgctgtccggcttcgttgatgccattatgatccgcacctttgagcatgaaaaagtcgaagagcttgccgagcatgctgatattcccgtcataaacgggctgaccgaccggtatcacccgtgtcaggcactcgcggatctgttaacaatacaagaaataaaaggaaaattaaaaggggtaaaagtcgcctatatcggtgacggaaataatgtcgcgcattcacttatgatcggctgcgcaaaaatgggctgtgacattgcggttgcttcgccgaaaggctatgaagcagaggaagaggcggtgaatgccgcgaaagaagcggcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgctccgtatcaagtcaacgcctcactcgtcagtctcgccaaacccgactatacatttttgcattgcctgccggcgcatcgggaagaagaggtcacgtccgagattatcgacggcccgaactctgcggtattccagcaggcggaaaaccggcttcacgcgcaaaaagcgctcctgaaagctcttctatacaaacaggatgaacaaaaaaaccgctgaatctcattcagcggtttttgatatttctccgcatacaagcgcatactacataaaaaagaaaaaggaggaaatgacgtgggacagcagcatcaattccgcccgggacaaaaagcgccgaataacggtgtgtacgttgaaatcggcgaaacgggaagcatggtcaaaaatccgcaaaaaatcaagcttacggtgggagaaatgttccctgaaacttcaaaccacaacagattgtggacgtaccaacgaaaaccgtgaacacaaaaaaacctgctgaatagcaggtttttttatttaatgctggtttgcatcctgtttgacaggcatgatctccgcaagaacaaagactagcaccgcaataaccacggcaataacggatgattgcttgaaattgtacgccgcgctgttcatggaggcgaccaaataacaggccatatgtgttaaaaggaacgtccaaataaaaccgataataaaccgcacgtttccacctcgtccttcattttattctacgttgtatcataccatacataaagcgcgggcggaaggtcattttctcatcaaaaagcgcgcctgaaactgacatgtgcccgcctgtcttgccgtctgacggaaaattcggttcccgtgcttgggataatagccaaaacatagcagcaaataggagtttatccgatccgttttcattctttttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaactcactttgtcagccgggactcaagcttttggctcgaacatgaagggaggaaccagctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacacttgctcgcagaaggcatgggcgccctcatcgccgatcaattgctgcagtcttcaccggagcatatccgttcagccgcaatgttagatccttgtcttgaccttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgtgccggtacatatatggcaaagaacgaccggagcgccgtacccgtacaccctgcacgcgaacgcgtataaagaagcccgggaaaagaccggaagcaagattgatatcacgtatcacctgcttgagaaccctgctcgtatgtacagagccatctgccggtttttccgcagtcatgaaaaagacctgtaatgaatagaatacaacagccatctcttttcagagggctgtttggcttgtgtgtgtatgaaaaaccggaaaggcggcagatgtgatgaaaacagcgctgatcattggagcagatgaatttctcggcctttcattgtgcgaacggttgatggatgaaggtgtgcacgttgatgtcattttggcagaaccggaggacaaaacgaggcagctgtatttagaagaacgtttaatgtggctcgcgagaaacgggctttttcaaataatagagaaaatcggtgaaaaggaatacgatcgtatctgcgttcaatacgggagcgggtgtctgcctgaaaaaagggctgagcctttatattggattgtttacagtgaggatcacggagactgggaaaaaaacggtcagcgggatacggcaaaagcgattatccttcctcccctttacggtccgtggacggaagcaaaagaagatggcgaaagcaggatctttttagaagacgcggtctgcgggctgatgaataagcttgaggctgacggcacagaagacgaaaatcagattattaccctggaaataaaagaaaaaacgcaaaaaacggaagcggaagaaaaaattaaagaatggaaaagacaattttcatcaatattcgacattttttaagaaataccttccatgttatgtgcattaccgctacaataaacgtatatcaattatacatgttatgagtttgaaaaggggttgaacatggcttgatcaccaggcttgtcatgatcttttctgtcctccttttattgagcggatgcacacaaactccgtttaaaggaaaaattgagaaggtcggaatgcttttccccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggttttttcgggggaatgacggccgcccatatgtcaaaaaccaatgaggtcggtgtcatcgcctcctttttgtggcagcctgaagtagacggctttatcaaaggggcgaaatatgaaaagcctgatatcaccgtcaatactgaatttacggaccactgggataacggcaatgaagcgctgcatctttacgagaagttaaaagcggagggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtcaaaacgtataatcaaacaaatgaactgccgtcaaatgaatagaggtggatacacatgcagcatgaaaagtctcttgaatttatgcagatcgcgatgaaatacttgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggttctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgctgaagatatgtattcatccggcatggccgctgaggctgcgcaaaaagcgcttgatcaggccggcatttccgctgaggagcttgatatgatccttgtggcgacggttactcctgaccagtctttcccgaccgtttcctgtatgatacaagagaagctcggggccaaaaaagcgtgcgcgatggatatcagcgccgcatgtgcgggttttatgtacggtattgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactttcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgacgtcatcgtcatggtcggtttcggcggaggattgacatggggcgccatagcattacgctggggacgataaaaaaaggtgaggtgcacacaagatgagtaaaaaaagagtagtcgttacagggcttggagccttgtctccgcttggcaacgacgccgaaacaagctggaaaaatgcaatcggcggcgtatccggaatcggaccgatcacacgtgtggaatcggacgagtatccggcgaaagtagctgctgaattgaaagatttcaatattgaaaatcacatggataaaaaagaagcgcgaaaaatggaccgcttcacgcaatacgctgtcgtagccgcgaaaatggccgttcaagatgccggtctgaacatcacagacgagatcgctccgagagtcggcgtttgggtcgggtccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgcccctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatctacggggaaattgtcggctacggctcaacgggtgacgcctaccacattaccgcgcctgcccaagacggggaaggcggtgcgagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggacaaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaaccggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaagaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacaagtgacaaaggacgaaaaagatgagacatttcttgatacaatcatgatggaggggctggcagaatatgctgtatatgagcggttcggctcaagtcttacggcggaatggacgtcctactatacgcctgagcagcttgattttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatccctgcagtcgacggggttgattttcacattaacaaaggcgaaaccgtcgctcttgtaggagaatccggctcgggcaaaagcatcacctcgctttctattatgggacttgtccaaagctcgggcggaaaaattatggacggctcgattaagctggaaggcagggacctggcctccttcaccgaaaacgaatattgcaaaatccgcggaaatgacgtctctatgatctttcaggagcccatgacttccctgaatccggtgctgaccatcggcgaacaaattaccgaagtgcttgaataccataaaaaaatgaataaaaaagaagcggctaaaaaagccgttgagcttctggaactcgtcggattctccagagcggaacaagtgatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttctattctgctgatcactcacgatttaggtgtggtttccgaagccgccgacagggtgatcgttatgtattgcggacaagtcgtagagagtgcgggtgtggaggacttatttttaaaccctcttcatccgtataccgaagggctgttaaactccataccggtgatagatggagagattgatacattaaaagcgatcaaaggcagtgtcccgacaccggataatcttccggaaggctgccgattcgccccgaggtgttcaaaagcgatggacaaatgcaaaacagggcagccggagctgataacgcatgaaagcggccgttctgtaagatgttttttatatgaggaagagggtgcccaatcaaaatgacagctgcaggccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctttttaaggggcaggatatctccggcttatctgaagaaaagctgagaaaaagcgtccgcaaaaacatccagatggtcttccaagatcccttcgcatcccttaacccgaggaaaacgctgcgttccattattaaagagccgttccagactcaccatatgtacagcatgagcgagcggaacgagcgagtggaggagctgctggcgaaagtcggccttcacccgagctttgcaaaccgctatccgcacgaattttccggggggcagcgccagcggatcgggattgcgcgggctctgacgttgaatcccgagctgattattgcggatgaacccgtttccgcactcgatgtctccattcaggcccaagtcatcaatctgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattacgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaatcggggaacccacactttttaactctctgtattctacagatgacgcaagtacggatattgaaaatatgctgtacagctttttaacgaaaacggatgaaaaactgaacgtgaaattatcactcgctgaaaatattaaagaattagacggcggcctagcatatgatgtgaaaattaaaaaaggcgttaagtttcatgacggaaaagaattgactgcagatgacgtcgtatttacgtacagtgtccctttaagcaaagattacaagggagaacgcggctcaacatatgaaatgctgaaatccgtagagaaaaaaggcgattacgaagtattgttcaagctgaaatataaagacggtaatttttataataatgcgttagacagcacagccattctgccgaagcacattctcggtaatgttccgattgctgatttagaagaaaatgaatttaacagaaagaaaccgatcggttcaggaccatttaagtttaaagaatggaagcagggccaatatattaaactcgaagcgaataatgattattttgcaggaagaccgtatttagatactgtaacgtataaagtcattcccgacgcaaatgctgccgttgctcagctgcaggcaggcgatattaatttctttaatgtgcccgccactgactacaaaacggctgaaaaatttaataatctgaaagtcgttactgatttggcattaagttacgtgtacatcgggtggaatgaaaaaaatgaattatttaaagataaaaaggtccgtcaggcgctgacaaccgctcttgaccgcgagtcaatcgtcagccaggtattagacggagacggcaaggtagcctacattccggaatcccctttatcttggaactaccctaaagatatagaagttccgaaatttgcgtacaacgagaaaaaagcgaaacagatgcttgcagaagccggctggaaagatacaaacggtgacggcatcctggataaagacggaaagaaattctcgtttacgcttaaaacgaaccaaggaaacaaagtccgtgaagacatcgctgttgtcgtccaggaacagctgaaaaaaatcggcattgaagtgaagacccagatcgttgaatggagcgctctcgttgaacaaatgaaccctccgaattgggattttgatgcaatggtcatgggatggagtttatccacattcccggatcaatatgacatcttccattcaagccagattaaaaagggcttaaactacgtttggtataaaaatgccgaagcggataagctcatgaaagatgcaaaatcaatcagtgacagaaagcagtattcaaaagaatatgagcagatctatcaaaaaattgcggaagatcagccgtatacgttcttgtattaccctaacaaccatatggcaatgccgcaaaatcttgaaggattcaaatatcatccgaaacgtgaattgtataatatcgaaaaatggtggcttgcaaaataattttcccttaaggggagggagagcgttttctccctcttctgtttttaataaggaaagtaaagggggacaagtatatggctgcatatattctcagaagaaccttaatgtctatcccgattttattgggaattacaattttatcatttgttattatgaaagccgcgcccggagatccgatgacattaatgatggatccgaaaatcagccaggctgacagagagcagtttattgaaaaatacggtttgaatgatcctcagtacgttcaatatttaaagtggctcggtaacatggtacagggcgatttcggaacgtcaattgtaagaaaaggaacgcctgtttcagaattgattatggcccgaatgcccaatacgctgctgctgatgctcgtttcaacgattttggcacttatgatttctattccgtttggtgtcctgtcggcaaagcggccttattcaaagctcgactatggcattacgtttacctcatttataggtctggccattccaaacttttggtttggattaattttgattatgattttatcagtaaatctcggctggtttcctaccggcggtgtcgagacgctgaatgccgatttcaatatatttgaccggattcatcatttaattctgcctgcattcgtattagctacagctgacatggccggactgacgagatacacgagatccaatatgcttgatgtattaaatcaggattatatccgtacagcgagagcgaaagggttcaaagagaaccgtgtattatttaaacacggattgagaaatgcattattacccgtcattacaattttcggtttgatgattccctcgtttatcggaggatctgtcgttgtcgaacaaattttcacatggccggggttaggaaagctgtttgttgattcagcgtttcagcgtgattatcccgtcattatggcgatgaccgtcatttcagctgttcttgtggtcattggcaaccttgtcgctgatattttatacgcagtggttgatccgagaattgaatattaaaaggggggacatcgatggctgagctgaacacatctccgtcaccggagatcgggctgaaagaaaatattgctgagaaaccggaaaccatgacaaaaatcttttgggaaaagttttcgaaaaataaactggcggttgcaggtgctgttattctgttcgtgattattatgtcagcgatttttgcaccggtgattgctccttattctcaagagcagcaaaacctgcttgataaatttaaagcgccgggtctagaacatttgatgggaacggataaattcggacgtgacatcttcagccggattctgtacggcgcgcgaatctctttactagtcggatttgcctctgttgtcggctctatttttatcgggacgattttaggagcggtagcgggttattttaaaggtttcgcagatgctgttattatgcggttggtggatatagttctttccattcctgatattttcttattgattacgcttgttacaatttttaagccaggcgtggataaattaattttaattttctgtctgacgggctggacgacaaccgctcgtttggtcaggggagaatttttatccctgcgatcgagagaatatgtattagccgctaaaacaatcggaacaaaaacacataaaattattttttcacatatcctgcccaatgcgctgggaccgattattgtgtcagccactttaaaagtcggatcggttattctggccgaatcggcgctaagttatctcggtttcgggattcagccgccgatcgcaagctggggcaatatgcttcaggatgcacagaactttacgattatgattcaggcttggtggtacccgttatttccgggactgttcattcttcttaccgtattgtgcttcaactttgtcggagacgggctgcgtgatgcgcttgatccgaaaaatgtgaaatgatcacttatttggactctacgttaagtgaaaattatgctaactagagtcttcttttgaatcaaaataatcagaaaaataaatttattcattgaaatagacgaagagcatagttataatataattacaaaataatacatatttaatataaaaagggaagaggggacgatttgattcatgactctaagaatgctatttcagatgaaggcactgaattctttaattcagcttatcaagaagtctattcaaatttgcttgctagagatctggatgatgaaattaacttcattaagaataggattttaaagcattttgaaaaccctaaaatcatggatttttgctgcggtcatggaagacatttactaaagctgtgggaagaaggctacaatattcacggattagatattaatgaaaacttcctgaaacatataagtgataaatctaatgctcatgttccaacttttttagcggatgggaggtgttttgtaccaaaacatagatatcatgttgtcttgaatatggaaacatctattgtatatatgagcgataaagaaaacaaaaagatgctggaaacaatgtatttatgcttagaaactggtggtaaattattgttgcatcttgcaaatagagagtatttaattaaacactttaaccctatcatttggtttggtaatgatgaatcaggttatgcattagagaaaagaagtcttgatttattaaatggcacactgaaaataaaccaaacaagattgatcaataataaaacaagtcatcatgttataacaatgaggttatatactgttactgaaataaaaaacgcattagaacaaacgggttttaacattgaacatatttatggggattttaatggaagtgagtatactattgaatctcctagtatattggttatctgttctaagtgaaaacttgaaagggggtgaaaaagttgaagagaggaataaaaattattattgaagattaataatttatgattgcacagaaaatgcgtgttattttaatagcacgcatttttcatggatagaataagatccatttacttagacagtgggtgaatgaaacagaacaaaaaataatatattttttagttagaaataaaagacggaaagggtcaaatgaatggttcctctttttaaaaacacatcatttattactttttgtctggcccagcttctgtcacgtttcggggacgggctgacaaccattgcaattttatatatcatcggtacggcttcgcaagaccctttgctgattggatttgtgcttttttgtcaatactctccgatgattttattcggcttatttgctggatcaattgcagaccgatttaaaaaacattttgttatgattggcgctgatttatatcgtgccgttattttaattcttatggtttttatagtacagtatccttacgcactgatcattttggtctttttatcaggggtaggcagtgctttattttaccctgcacgttcatcttttgtaccgattgtagcaggtgagaaatatatttctgaagccatggctgtgtcacaaagcatctattctattatgcagattgcaggaccgggttttgcgggaatcttgttgatgtttttatcaccatcatatctcttagtcatagacgccgctacctatttcttttcagctttgttcatctcagtaacagcagtgacattaaaaaaacagcagttagagcacactgaaaatccatcagttataaaacctttgagcagttccattaaagaaggtgttcaagtcattcttaaaactgctccgctttcctttttaatcctgctattggcgcaagtaatgtttgcagctggaattttcaatacgacttctaattcattgctgctacatatatttcaagtgcctggatttcattttggaatgattgaagcagttgctggaatcggtgcagtcataggtgcaatgatgggccctttgcttttaaggtatttgaagcctggttatttgcttttagtcaccacagttttgatgggaatatggatgctcacggtgattcctttagaacgtgcagaagaatgggccggtttacttccgatttacctatgggtattgggaatagggttgatgaacgcttttctaaatgtaccaattagcagtctatttctaggattaacgccttccaaatatagaggccgtgctatggcaatgttgcagatgtcttcaaattttggtcttgtaatggggattctaattgctggtctgctatcaaagtattttggtgtcgtcctcatcacagcactgtcgggcggattgttggtgcttgtttcactgtttactattaaaatgaaaggatacaaagccttattatcaattgaaaaaaagcccagcaatatggctcaattgaggacaaaacggaaatctcatattgaaatggaataatttatctatcccttgcctatactgtggacaacagtttttataaagtgaggggtcgaatatgttatttcttcatgatgtatgggttaattggtttgaaggggaagaaaacggctacaatgtatgccattttcacgaatggcggaaggaagacacggttgagcttttggatcagacgccgctgctcagagtgccgtcagtattatttcattacatagaaaacgacttatcagagcttccgaaagagctgcttgaccaagtccaccagaagtcatacgtgcgaaaaaatcatgagcggacaaagctggagtactgttttgtcgtgacagacgggatcggcatcattgccgtggatacgatcgggtataccattccggtcagaaagagccgcctgattccgagacaggagcagcttgtttatgaaatggtaaaggatgtagaaccggaattgtttcaatttgagccgtcgcaattggagtcttcaaaggaatatcacattttgtcattggcgccggagcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggggattctcccgcctcttttttttatcttcttttccgtccgagacccatggcgttttccattttcttcaccattttgccggccgttttgtttgcgcgcgccgcccctttgtcgagaatgcggtcaagctcgtcgctctcaattaattcacggtagcgctcttggatcggtgtcaatgcgccgataacgacttcggctaaatcgcttttgaattcaccgtaccctttgccttcatatttagcttctaattcttcaattgatgtgcttcctaaaatagaatagatcgtcaaaagattagaaacgcccggtttgttttctttatcatactttacaatgccttcagaatcagtcacggcgctcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgcgtcatccgctcaagctcgccgatatatgcgacgcattggagcatccaccccgcctgggcatgagcgggaacttccgactggataaagagggtcgctttctcgggatcaagtccgacggccagataaagagccgcgagattgcggatgttcttccgcagctcaagccgatcctgcggaaccgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttgctttaggggtggaaatcctcaaaaagaactgaaaatgcttaaatgataacgtatatcaacatttcgtataacgaatattatatgtaaaaagcaatatgaactggaaattacattaaaaaaatttagttaggtcatgctttaaactatagaagtgtatcacctttttgacagaaaaactgaccaaatttaaatattttaaattaagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggtaaaaaagacaccaaaggacagacttcacttaatatcaatattaaaaccgagccgttctcattgcatccgggtttagcgaatgattccgtttcaggaggcgtaatccgacagacttttgaaggattgacacgtgtaaactccaaaggtgagcctgaagaaggaatggcatctaaaattgaaacaagcaaagacggaaagacctatacatttacgattcgtgacggtgcgaaatggtctaacggcgaccctgtgacggcgcaggattttgaatatgcatggaaatgggtgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgccgaaaaacataaaaactggaacacaaacgcgggcgaaaattatgtgtcaaacggcccgttcaaaatgacggcctggaaacacagcggttccatcacgctcgaaaagaacgatcaatattgggataaagacgctgtgaaattgaagaaaatcaacatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagcgaaaccgctgaacaatgttaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttacttcaaagacaatgacgtcaaatcagctaaagaattcttaaataaaggactgaaggaattaggcgtcaagagtgcctctgaccttccggcgatcaagctgtcctacaatacggatgacgcgcatgcgaaaatcgcgcaggccgtacaggaaatgtggaaaaagaacttgggcgtcaaagttgaacttgataactccgaatggaatgtttacatcgacaagctgcacagccaaaactaccaaatcgggcgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttatcgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacttaaaatctgtggcgatgtgggacttcgggccttcttttaaatataaaggccaaagtgttaatgatttaatcaattcaggcttccccgtctcattcactctcggtgcagaagctattctcctcgctttagcgttcggtgtgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcagggtgggaatcctgggcatacacctttctgccctccattgcgctcgcttccatgccgatggcgttcattgccagactctcccgttcaagcatgattgaagtgttaaacagcgattacatacggactgcaaaagctaaaggactttcccgtccgtcagtcaccgtgcgccatgcgctgcgaaacgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagatgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaagatatgattatgccaccaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatactcgtaacgatgacactgacggttccgacggcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtgaatttccatttgaataaaggagagacgctggcgatcgtgggggagtcgggttccggaaaaagtgtgacctcccaagcgattatgaagctgattccgatgccgccgggctactttaaaagaggacagattctttttgacggacgcgatatcgtgccgatgtccgaaaaagaaatgcaggccatcagaggaaaggacatcggaatgattttccaagatccgatgacctctctgaacccgacgatgagagtcggcaagcaaattacggaagtgcttttcaaacatgaaaaaatctcaagtgaagcggcgaaaaagcgcgccatagagctgcttgatctcgtcggaataccgatgcccgaaaaacggatcggccaattcccccatgaattttcaggcggtatgagacagcgtgtcgtcatcgcgatggcgcttgcggcaaatccgaaactgttaattgccgatgaaccgacaacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggcacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggcgaaacgctcggccttgtcggagaatcgggctgcggtaaatcaacgacgggccgcagtattatccggctgtatgaggcaaccggcggggaagttctctttaacggggaaaatgtccacgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcaggcggacagcgccagcgtatcggaatcgccagagcgctggcggttgatccggagtttatcatcgcggacgaaccgatttcggcgcttgatgtctccattcaggcgcaagtcgtcaatttaatgaaagaattgcagaaagaaaaagggctcacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgcttcctgatccggactatgaaagaaatcgcacgcgaaagaaatacgatccggcagttcatcagctccaagaaggagaaaaaatggaattcagagaagtgaaaccgggacattttgtcatgtgcacagaagctgaatttaaaacctatctataaacgtatcatcctccaagactgagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccatgccgctgtgaaagaggagcagccgcttgtaaaagtagcgctggctgaaaaagaattgccgaaatcaaatgcacggttcgcttatccgtcagggctgcatttttcacatcctgataaggtgcggggcatttacgtcacagggcattcagcgggaggaagcaaattcggggagctgacagactttgtggacaaaacggaactcaatacaatggtcattgatgtcaaggacgacaacgggaacctcacctttaagccggacggccattctgagtatgcaaaaatcgccaagccgtacatcaaagacccaaaaaagatgatgaaaaagctggaggaaaaaaagatctatccgatcgcgcgtattgtcgtatttaaagacagcgaactcgcgaacaaaaagcccgagtggtcctttaaagaaaaaaacggaagtgtctggaaaaacggccgcggcgaatcgttcgtcaatccgtttatgaaagaagtatgggattacaatgtaaagattgcaaaacaagccgtaaagatgggttttcaagaaattcagtttgattatgtccgttttcctgaagggtttgaaaaacgtgatgacgaactgacatacggacacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccctacaatgtcgtcaaagaatacgcgaaggtggaaaataaaaagctgtccaagctgaaacacccgcctgtatcgcgtccgtggcttcaggacttcacggcatcatatctcggcagcggaaattatcaaaagtacgggaaacgccaggtggaggaccaggttaaagcgctgcatgatgaaggaattgacgaatttttattgtgggacgcggcaaaccgttataccaaaaacgtcgattacacaccattttaaaaaaattgaaaccatgttaaaggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccaggggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgaaaaaacggatgaagttctcaaagtcattgatgagaaaaaacaaaaaaacattttcgatcagctgagctaattgagaatggggaaaaatcctccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgccaactgatataagcttacgataagcatggaaaaagcccaaaaccatcgcggtttgggctttttgttatttttcagtctgctggtaaatcatactggcgaggataacaaaaacaacggtcaaaatcggcagcatcatctgtatcatgccgtgttctgccataaaaaatgacagcttgctgtctccggcaatcatttcaccgccggtaaatgcgagaagaccgctcccggcatacatcaataaaggcattttttccatggcggcatgaacgagcttgctgccccaaataataatcggcaccgagatgaagagaccgatcactacaagtgtcagctcaccgtgagaagcgccggctactgcgatgacattgtcaagcgacataaagatatcagccagaacgattgtgcggatggctttccaaagagaagaactgcttttcacatgctgcgcatctttcttctcaatcagaagctgatagccgagatacaataaaaataccccgcctgcgcattgtaaaaaaggaacattcaataaatagaccgcagcgctcgtcagaacgattctcaagacgactgcgataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcggtgtaaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccctgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattggtgatcgctgatcatgcgttatatacaataaaaaaacactttgcatcataacaaaccgatttctctcagcagaaatcggttttttttgttctgaatgacaggatgaacggctgaaaaccgtataacggctctcatccgcaaacaggattatgccttcttcctgctgaatacaacaagattcaggaaaggagaagatgcaacatgttcagtgcagtgactgccggcggacggctcattcagctggccggaagctattcaaaggaaaaagcggcggagctgagaaagaaacgctggttctgccccgtttgcaaaagtgagcttgatatcaaactgggacgcgaaaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagaaaggctggcttttgaatttcaatgtgcgaacctttcggcggactctttaaagagccggacggcaggcctgaaaaacgccgggtaccggccggtctggatcattggggcaaaacggttaaaacggatggccgcgcaatttttccggctttctgcttttcactggcagttctttgaagtcaattcattttcctccttaatgttttactgccccgacgtccgctccttttacaggctgcattccatcactccgttttacaccggctattcttatgccggcttaaccacaattcctcttcacaaagcaaacctgaaagacatttgtcatccggaagggcggcacagcgtcagactttcctcgtgggggcgtgccgttgccggcttccgcaacaaaggcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacttgcggcttgcggaactttctaaaaaaggcgcgccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgccctcatctcaacagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgacagaagtgaagtaaaggcagagcatacatggagactagaggatatttttcctagtgatgaggcctggaataaagaatttcaagcagttaaagaattaattccgaatttatcttcatttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattctggaaaaagaggagcttaagctttactcccatgcaattgaagaaattacaaaacagcgtccgcacgtgctgagcgaacaagaagaggccctgcttgcggaagcctctgaagcgctgtcgtcaccttccaatacattcagtgttttaaataacgccgatattacgtttccgtcgattaaggatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaactataaatcagcacgggaagcggctttatccaataacagcattcctgaagaagtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtcacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttaatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaaggattcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacgggctacagtgcggcccaagcgctgagcagccagatcttaaaagaaggcaagcctgcggtggagcgctataccgaattcttaaaagcgggaagctcggaatatccgatcgacatactgaaaaaagcgggggtcgatatgacatcgcctgaaccgatcgaggcggcctgcaaaatgtttgaagagaaactgaatgaaatggaagagcttctttcgaaagtgaacccttcgtaattcaaaaaagcctgtgcattaaatgcgcaggctttttctaaaaccccttaaacgtttttcggtgattcagccggtacagggcaaacaatatggacagaaacagcagtggagatgtaatgtaaatcggcagcatgtgcatcatggccagcaggtttaaaaagaagaaaaacacaatcattccgatgatcaatactgtgcggagcattgatttccctccttgtttatgattgatatattctatgaaaacaagcagtcagttatgctttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggtgccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataagatctcttcgtatacgtcataagaatagttgccgggaaccttcagcccttcatcatcatgcaggctgttaaagaacgtcaatgtcggattgacggtgacgtccatttccgccgcgattttcatatcgcactgaagcgcttttaccgcgctttgcgaatggaggtcgcgcttgaattcttcaacatccaatttcgtcttttcagcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgcaagaggctgatcctgctcaagccaaaggcttccgtcacagggcatcccggaacggttcgcaattttttcccaagcttcggcaagaaggtgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcgtccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcggaatgcctccgtaccgatctacgttgccggggcctgcgttgtaggcggctaacgcgagagatacatttccgtcgtatttcgtgagcatctgctttaagtactttgtgccgccctcagcgttctggacgggatcaagcgggtttgacaccccgagtgattctgccgtggaaggcatgagctgcatcagccccattgcccccgcaccgctgaccgctttcggattaaagcctgattcctgtttaataaccgcgcggatcagtttttcgtccactccgtatttttcggctgctttctgaatggcgctgtctattgaaaagtttccggtgctgatgtcagaagccgcattcggagactttatgctcggggaaacggtctgtgaagctgccgcggaaccggatgaaaccggaattctcggtgaatatgaagcgtgagcggtccgcacaccgtttaaaatccctgattccggctgctgccggacggctgtgtccgtatactggctgagcagcgcgctgaaattggcaagcgggctttctgaagattgtccgcctgaatccgtgcttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcccgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattcctagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatgttttttcatgcagagtgcttcactcagcttcaaaaattctgattttgtcagcaggtttttgaattcaatttctatttcttgggtcatgacagtcttcctttcaggacgaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatatctggccggatctgaaagaagccttagaccaaagaaaaccggcggtccttgaggccggcggaaaaacggttgaactttcagagctgcatgaagaactcgattatcttcttgaaaatattaaagataatgcaaactacggagatatggaagaaaaagtgaaaagcgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagaagaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtaaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcttttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacgatcaaaagcatagaaggcagtctcgtcgctgacgtggaaattaaaggccagctgtttgaaacgttcaggggagacggtttatgtctgtccacgccttccggaagcacggcttataataaggcgttaggcggtgcaatcatccacccttccatcagggcgattcagcttgccgaaatggcatctatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggatgccggcatgacggtaaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcggaaagcatcgctaacggagtgatcagccactaccgaaaaagcggcgtgcaatcaacggttcatcttgtcacccgccttgacagggatacatcgggggcgatgctcatcgccaaacatcggctttcccattctcttttgtcggcagcacaaaaaaaggggcttgtcagcaggcgatatctcgctgtcgtacacgggatcatgctgcagaaggaaggaacggtggacgcgcccatcggaagaaaacacgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacattgtacggcggaaaaaatgagggaattgcccggcaggctcttcacagtgagcggctttcattcgtacaccccatgaccggagaaacgctcgtttttcacgctccggtgcctgacgatatgaaaacattaattgaacacatgtaaagcccgaaccgtttaccggtttcgggctttttttcatgccttcctgccgtgatcctcgcgaaatcgtgaagcatcatacggcatagagctttccacagagacggtttcatgctcgggaaaacgaaagcctgtcagctgattgccgaagacacagcctgtatcaatgttgaccgtacggttgacgatccgggggcgttttaccggggtatggccgtacacaacccacgccttgccttcatagtcggcagcccagtctcttctgacgggtctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcgggagacagctctttcagttcggctgccgtcgtttccagtccgtgcatcacttttacggggtttccttttaagtaacgatacagtttgttgcaatgatttcccgggacataacggacggttcctttttcatatgcttttgccacaaaacgcatcacttctacggattttgggcctctgtccgttaaatcccccgcaaagacaagcgttctgccttcagaatggacgggggttccgtctttcacttcatatccgagcttttgcattaaggcgatcatttcgtcataacatccgtgtatatcgctgatgatgtcataagccattcttttcagcctccttattaacggttttttatttattatggggctaattcctatacctaattacgctgttttggtacaaattaaaaaaagaattgaagaaataaagccttatcacttttttttcgcgttcagccttgttagaatatgcgttatgtttttaaaaaaagtaaggtttcgtccgcttaaagcgggcttttataacccttgttttaaggaggtatttacaaatggaacacacatcagtcgcatctttagtcgtcgttctgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattccttccgaacggcaaggaagcgcccaacacgttttctgccgcgctgattatctttttcggcatctttattttatcattgctgctgtcctatgcctttgtattagccggttttattcaaaacgcatttttaatgacgcttattatttcaacaatatcactcggtgtggtggttccgactttaaaggaagaacggatcatgaactccaatatcggccagatcatcctgcttgtcgccgttatcgcagacttggctacaatgattctgctcgctttcttctcttctctttacggagaagacagcggaaatatgtggcttctgttgattctctttgcagcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggatatttggacgcttttccaagatccgaaaacattaacgatgattccgctgcttctgcttgcgctgtttatcagcaaaatgttcccggtgttttatttaaagaaatggtacgacaaaagaaccgtgtttgcttcgggctttttgctgacgtcgacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaaccaaatgacgctcccggttacgctggaattgcctgaggaggaatatgaagtacgggtcgtccatgtgtatcaggaaaatgccggggaaacgcttgcggaatccgttttttcggttgacacgatttctgattacgagcccggcacgcttgagtcgcacggtatttttaaaacggatattcttgtcgtggcgacgggaaatgaagatgtgaacgctgaaatcgccttactggcgaaagagaaagggactgagcgtatcatcgcaagcgtcggctcggttgagcatgaaacaaaactgaaagaagagggcatcagtattttttctatccttctgtctacaaaaacgctgctgcgcgcgttaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacacggctgaaaacaggagaccgtctcatcgtcacaggctcgcgcaactacgtgtcagaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcaggggggaagacatgatgacattttctgaagaatgcagacaggcggctgccgaatggtgggacggaagttttgttcatccgtttgtaacgggaatcggtgacggaagcctgccgatagaccgtttcagctattacgtactgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttaggaattacggaagaagagcgtgcggcatttaaaccggcaccgaccgcctattcttatacgtctcatatgtacagatcggtgatgagcggcaattttggagaaatattagctgcgcttctgccttgttattggctttattatgaagtcggcgaacacctaaaagagtgcaaaccggatcatccgatttatgaaaaatggatcggtacatacggcggagactggttcagacagcaggtcgaagaacagatcagccgttttgacgagattgctgaaaacagcacagaggaaatccgcgcgaaaatgaaagagaattttgtgatttcaagctattatgaatatcaattttggggaatggcttataaaaaagaaggctggtccgagaaggacggaaaagaggtggaatcctttggagctgcacgcggtaactgataatcgcaaacccgttgccgagctggccgaggatattctatcgattcagcgcgaagtgagctttatccatatccgtgagcgggataaaacagcgggagagatcatgcagcttttgtccattttgaaaaagggcggtgcggataaggacaaattgatcatcaatgacagggcggatatcgcgctttttgccaacatacaccgtgttcagcttccgtcccgcagcttttccgtaaagcaggtgcgaagcagatttccccatcttcatatcggacgttcggttcattcgctggaagaagccatccaagctgaaaaggaagatgcggattatgtggtgttcggccatatatttgaaaccgaatgtaaacaaggacttgaagcaagaggcatcagcctgctttcagagatcaaacgcacgatttccatccccgttatcgcaatcggcggaatgacactgcagacgatcggacacacaaagcaggcgaagccggacggaattgccgtcatgtcaggcattttctcagctgaaaatcccgaggaggcggcaaaacggtatgcacgcgcggtaagggaggccgattatgaagaagcactatgatacggcggtgatcggcggcggaattatcgggtgcgccatttcttatgagctggcgaagacgcagcagaacgttgtcttgtttgaagctggagaagtcggccgaaaaacgacaagcgctgccgcgggaatgctgggcgctcatgcggaatgtgaaaaccgggatgcgttttttaattttgccatgcacagtcaaaggctgtatgaagcggcggggcaagagcttgaggaagctagcggcattgacatcaggcgccataacggcggaatgcttaaactggcgtataccgaagaagatatggcccgtttacggaagatggatgatctgccttccgtcacttggctttcagcggaagatgcccttgaaaaagagccttacgcttcaaaagacattctcggcgcaagttttataaaagacgatgtccatgtcgaaccgtactatgtttgcaaagcgtatgcaaaaggagcgcggcgctatggcgctgacatatgtgagcatacacaagtcacttccgtaaaacgggtgaacggaaaatattgcatcacaacgtccggcggggatgtttatgctgacaaagtcgcagttgcaagcggtgtatggagcggccggtttttcagccggctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggcgactggagcgatacgcctgacatcggaggaattgaggccgtcattgcaaaagcgaaaaccatgcttcccgccatcgaacatatgaaaatagaccggttttgggcggggctcaggccgggaacaagagacggaaagccgtttatcgggcaacaccctgaagacagcggcatcatcttcgccgccggccattttcggaacggcatcctgttggcgccggcaacggctgaaatggtgcgggatatgatcatggaaagacagattaaacaggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgaccaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccgtctcggaatcagatattttaacctttgcagtgcggcggatgaacatctttgaagagtctcagcctaactttctcgaacagcttgatttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcggacgatgtcgtgctcgcaagacgtcttgaggagctcggagtgcatgccattatgccgggcgcttcgccgatcggttccggtcagggaattttaaatccgctgaatctttcctttatcattgaacaggcgaaggtgccggtcattgtcgatgccggcgtcggatcttcaaaagacgccgcctacgcgatggagctcggggctgacggcgtgctgttaaataccgctgtgtcaggcgcagatgatccggtcaaaatggccagggcgatgaagcttgccgtagaagctggccgtctttcttatgaagccgggagaattccggtgaaagattacggaactgcaagcagtccgcgagacggtcttccggtatgacggacagatattccagacaggagctgtttcagccgatcggtccctccggccaagagaagctccggtcatctcatgccgtgattatcggcgcaggtgcgcttgggacggcaagtgcggagatgcttgtcagagcaggtgtcgggaaggtaacgatcgctgacagagattatgtggagtggagtaatctccagcgccagcagctttataccgaagacgatgtcagacaggaaatgccgaaagccgcggcggctgaaaaacggcttcggtctataaatagcgatgtagaggtcgagggatttgtcatggatgtcactgcggaaaatgcacccggattgattcgtgacgcctccctcatcgtggatgccgccgacaactttgaaacgaggctgattgtgaacgatgcggctgtgcagaaagggattccctttctgtacggcgcctgtgtcggcagctacgggctctcttttaccgtcattcccggtgtcacgccgtgccttcactgtctgcttgagacattgcctttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgcccaagctgcggcacaaacgattttccgtttttatcctatgaaaatcagacaaaagcggcggttctgtgcgggcggaacacggtgcagatcagaacggggatttccgaacagtttgatctgcaaaatcttgcgggacagctcagacgggcagggcttgatgtttcagccaacccgtatttaatttcattttgcacagacaatttcaagatggtactgtttcgtgacggcagagcattaatacacggcacaagtgatatcagcagagcgaaatctttttatcataaatggatcggataatgtgaaaggagcgaaaaacatcatgagcatatgcaaagcattgacgattgccggatcagattcaggaggcggcgccggtatacaggcggatctcaaaacctttcaggagctcggcgttttcgggatgtcagccattacagcggtaaccgcccagaacacgttgggcgttcacggcatttatccgctcacccgggaggcgctgggcagccagattgacgcggtggcggaagatttgcggcctgatgctgtaaaaacaggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggccgaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcagaaacggcaaaggggaaaaacattcagaccgcgtttgagacagctgtcaattttgtgcgggaagccgtggaacatacactcggcatcggagcgggacacggcccgaccaatcattttgcctttaaaaggaacagtctgcagacgagataaaaaagagaccgcttcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgcccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcatgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgaagccgctaaaaaagagcctgaagccgctgaaaaagagcctgaagcggttcacaatgccgccccagaggaaaaggtcccgccaaagcgcgtgaaaaagccgatgagcagaatgtccattcttgaaaaaattgatttcttaacgaagctgccgcataatatgccgcggaccctttgtctgatagaagccaacgggaaaacctacagaggcgtaatcgtcggaagaaaaaataatgcgatcttcctgcggacgacaagcaacggagcgccggcagaactcgcaatagacgatattacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctatggagatcgacttcaacgcaatagttcgttttttctaaacggaatacatcgcagagagagtctttatctgtaaaatcaagaatgtgcttatgctcgtcaaaagcaataagcaggcttaatgtggcacagccgtcacagaccctttcaactctgaaaaaaacggtgttaaaacacggaccgttatccagctcgccgacatttccgaatgcggtaaacggtgatgatttagaagtgaaaagtacaaacggcactgtatcgcctaatgaaaaacccggcgataaaaggttggaatagcatccggccgggcaatcttcctcgaccgcattttgcaggtcttcaatattttctaccgcttcacgcacacagtatgttgtatgcttgctcataatatccctcctgacttcacgttttatataccggattaaacgatatcggagagtcagccgcccggaagtccgggcgggctgatgattgcatctgtaatagaaggttggaaggggattcttctttaggaaagatgcgaatcaatgactatccgtgatgctttttctctttgtgcggctcaggccggtcaacaagctccggtgaaaggcattgaatggcgctgaagcagctcagatcaacttcaatgcaaaaatctgttttttctaaaccgaagaaatccgggtcacaaggatggcagacgctgagggtgtcgccgtgcacatctacggggcgcaatactgaaagcgttgcgcagcaatcacaaactctttctgcccggaagaaaatagactcgaagcactggctgtcatccgcaaatcctccgacgttcccgaatgtggagaacaaaccgccttttttatcaaacaagagaaacgggatggtatctttaccggtaaccgtcgggcttaacagattggtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacaagggtgatgactaagacggcaatcagtaaatttgtcgctgttgagatcaacactgcgatatcggcatctactgttgtcacgtttacgccgcgggagttttcgatgagcaatttttgacggttgatttgtttgttagctgttagctgcaataagtcttgtgcgaccaattcagcgatgactccgtcagcaattgaagtgagagtggccgttacgactgctgcattaatcgctgtcatgactgaagcgactgcttgaacgtctgttgacgttacgttaatatcacaagagtctctgataataatcgcttcttcagaaacttgtttgttgatattcgcctgagccaggtcttggtcaaggaaggcattatcttcgccaaatccatgtccgttacagcaaacactgcatcttcttccttctttttcttctttttcttctcgcggatgttcgcattcaggatcaagtgcaacccaagagtatggtctgctttccatatctattcctccttttcttttactattattaaatgagccggccccttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgttttcgcctgcatgtctttgactaatgcgatcagcatttctttttcttcatcagggatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttaccggacaaggtgcgattcatgaagatcagggttttcgcatatgtataaagaggtcaagttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaaaaggcatcagggcatttatcggtgaacttctcagctgctattggtgtacgggcgtatggtgcgccgcctttttaattgcggcgcagattgtgatccccgaggccgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgttttctaaaaaaccggagcttccggttttttttgttttttgccgaacgccggcctctgtccggcatagatcataggaggaggggatgttatgaatatatttgaatcattcataaacagtaaataccgccggcacaatcaaaatcagcgggagcatgacaactatatcttatctattgaaaaacagctgtctgagtttgatgaagcgggagcgcgctttgaggaatggatagatgtgtttgccgccgaaacagaagcgaaactgaagaaaaatgagcattctcaataaaatgaaatgaaatccgcaccggccctatgcatttatccaagccaaacaagtcggctcacatagagtatagagagtaaaggaggtgcttaaatatgggattcggatatggcggattcggcggcggctacggcggttacggctgcggcggcggctgcggatacggaggcggctatgtcggaggcggatacggctcaacatttgttcttgttgtcgtattgttcatccttctgatcattgtcggtgcatccttttttggctaaaccttaataagactttggataagcgcgggaccgttcagtcccgtgcttccctaatgtatgaaggatagagaaggagatgcggaattttttccttgtcttacgggcacacgttccgccctttattcatacaatatcgtattactccacaaaaggaggcacaccatggataatcaatttttcaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttaaacaataaataggcgtcagccggccttgctaaaaaggcctttttatgtgagaagaacccggcagtgatctgccgggttctttatatcctgagtgcgctccgtctgtccgtccgaagaaggggctcgagaaatcttgagctgcgcgctgtttttccccgcctgtacgcgggacaagatacatataaatgctgcatggcccttgtcatggcgacatacaggagccgtctttcttcttcgagcggagcgggatcgccctgtctcgccgtctcaagcgcgaagtcatgggggatcgagccgtcagccgcgcctaaaatatagactgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaaggggcttcattgtccggatgcttgcgaaaaacggaacgatctgcttgatctttcctatttgaaaaggcttcaggtcaggcagtttcgtcagtgccttaatcatcgtgcaatcttccgtgattgacagcgcctttaacgtttgcagggcggattgctttaaaaataaggcgggcagcagatctttcaccgcatccgtatcatcttcattctgactcgcatataagtaggcgaggatctggcgtacgattctgcggctgtagaacgtctgcacgccacggtcggcatgataaggaatcgatgattggtgcagtctttcataaatggcccgtccggcgctgtttgtccggtaaagcacggcaaaatcatcaggactcgccccgttttgaattttctctttcatatccgaaacgatcatggtcgcttcttcttcttcatcgtaaggataaaacatcacgggattgtgaacgccgtctttgacggcagaaagtgttttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgggccatgtcatcaaaatcaaattgccgtttttcccgcttctgccgttcgtaatgttcgtagagccggtacacttttttctcccagtcgtccgcaagcggaatggtctcatgggggagatatgtgtttttccagcagccgataagctgcagcgcctggtcgacgggaaactctttttcatccaaattttcttcatagagcgcctttttcacatattgctctttttgccactccatttttaaaagctggctgccgttccattttgaagaatcaaaatgatagagtattttatagaaaaaactgtggaatgttccggtcacgagccgggaaacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcgagcaccagcagggggccgtccgtttccgtgactgcccgcatctgttcgcggttcaggccgatgccggggaacaaagatgtatcagctgcctcggatgttggtgaaaacggttcggccgcaggcacttttttcgggcttttccattctgagacgatcggtttcggattctctgaaatcgcttttcctttcggcaggcggaacatgcctgcctccttgtactcttctttttctttctccgcttgtggttcctcggcggcgcatgctttttcacaggcggtgaagtctcccttttgccggtgataaaatgccggctgctctaaaatcgaaagccgcatcaagacaggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaatgaaaagcgaaggggaggggtacatatgatttatgcaggacggattcaaaaccagcagtattctcaatacgcaaaccgggcagcgggttataagcctgattacgccggcattacgaaagcggccgccctcgccaatgacagggtgtacagagaggtggagcgccgccaggaaaacaccgcagccgcagaaaagaaaatgcatgaggaaaaacgtaagcgctctctttcccgtctgccgcaaattatgggaaaaggccggttgataaatcaatatgtgtgaaaaagcccggaaatctccgggtttttttgagccgtatatatgaaagatgcggaaaggaatgattcaatttgagaaagctttcattattaattgcggggttatttctattcggcctctttactgccggaatgaaaccggcacacgcggcggagagctccgcagcaaaagatgtcactcttacacagctggcgccgcatgtctggatgcatacaagcatcggtacggcagacggaagtcccgtcgctgcgaacggattgcttcttgaaacttccaaaggaatcgtactgattgatactccgtggaatgacagtctcgcagagcaattaatgacacaaataaaacagcggtttcccggcaaaaggatgaccgatgccattgtgacacacgcccatgacgatcgcatcggcgggctgaacgcactgtacaaatacggtgtaaaggtgcacagcacgaagctgaccgccgacttcgcccggcagcagggatatgaccggccgctcggagatttgaaaaacgtgacaaagctgcagtttggcgatatgaaaattgaaacgttttatccgggaaaagggcatacggaagacaatattaccgtctggctgcctgaggataagctcttattcggcggttgcttaatcaaggctttagaaacaaaggaaatcataccaactccgggcttttatccggatcagtggccgcgcgccgtccgcaaagtcatgaaaagatatcaggacatcagcattgttgttccgggccatggcagtccgggggatgaccgtctgctgccgcatacgataagccttctgaaagaaacgtaaaaaagaagaccggcgctcccattacggagtgccggcttttttatctcttcctgatttttataaaactgaccaaagcaagtgcaagcgccaaaacggtatatcccgctatcggccaaatatgctgatgaaaggaagaataatctccggatatgacttcctgagccagctcgatcgagtggataaacggtaaggcataagcgatatgtttgaatgtgtcaccgagcaggctcacctccatccaagccccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagcagctgctgcgataaaacaaatgacgatttgtaaaatggctaacggaagcatcggcagtgcgtaaccgatgacataatcggctgtttttaaaggggaagcaaacaaacgggtcaaaagggcggtctgtttgtcttttgcgatcagcaatgcagagaacatcgtaaggaaagcgaaaccgaaaacaatgagtccgggtgctaaatgctgaattttaaaggtatcaagcggcgcatttttttcaatcgccgtaaacagaaacaatagaataacaggcagtgcgattccaaggatgatagataagggatcacgaaaaatctctttgcggttgcgaatggcgaaatcaagcataaagacccgcctctccgtcacaaatcgctaaaaaggcatcttcaaatgtggctgaatgagtttgttttttcagatcctccgccgtgcccagtgcttttaatgtcccattttctaaaatgcaaatacggtctgccagtgcttcagcctcttctaaatagtgtgtcgttaaaataatcgtcatgtctccctttaatgtctcaagatttttccacaactcgcggcgtgaacggacgtccagccctaatgtcggctcatctaagaaataaatatccggtttcgtaatcatgcccattgcgatgctgaggcggcgctgcattcctcctgataaggttttggtttttgctctttctttctcttttaattgaaacaattcgagcatctcatctgttcttttttttgcttcttttttcggaattccgtagactccggctataaactctaagttttcccgtacggttagatgaggagcgatggctgtttcctgcggggacatattcaatttcggttttattttatccaaatcagtcgaaatactgtgtccaagcactgatgcatcaccttcatccggagaaaggagtccgcaaagcatattgattaatgtcgtttttccggctccgttctcaccgagtaaagcgaaaaattcccctttctcaactgagaactcaagacggtcaacggcggcggtttctttataatgtttcgttaattgcttcagctcaatcgcgtgcatttactcatcctcgctatctgcgtcgatttgcttagcgtttaaaatatcttttgcaaactcgaaaaagagttcttgtttaacaagtgcgataccttgctggtcatccccaagcataagcagtgaatcccccggatttatatcgaaaacatctcttgcttctttaggaatgacaatctgtccttttgtgcccactttaacagtcccgaatatgtgttttccttttggtgccgtcatgtttatccctccgaaatatgaattgtattttttgtatgaattgtaatacttcgtatactaaacatacattaaccttccataaaatgcaataaaattcatgaaacggtattgttttcataaaaaaagcactcctgccatatcaacaggagtgcttttgtttttattgtttgtattcctttatcatttccagatgggggatgcccgcatcgagaaattcttcgccggatgtgacgcggtatccttgtttttcgtaaaacgggaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatacccgtctttcaagcgccatctgccggctccgaccggctggccgccgtcatatatgactatatgctctgacgtgtcttcgaattgatcaatctcttcttcttcaggaacgtgctgttctttaacaaagacctcttttctgacgaaaaaagcgtcgttcagctgtttttcagtttttacgatgatggattccaagcagttattctcctccgcctaataaaaatgtttcgtacacagtccatgagccgttatccagctgatagagcaggtgaaaacggtcgatgacttcttcgtgggaaatgtcttgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtaggtccatttatgatccccgtcgaaggtttcatacgtgtattcagactgtttgctttccagcagctgtttgagctcttcgttcggcacggtgaaatcaaggatctggccgtccgtcgtgtgaacgccggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaaaggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacagaggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatctattttatagtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacgcttggaagataagaggaagagaaaagctccttcttcttatgaagagggggcttttttatttttgaaaaaggatggtgcttactgatgacgcagcatgttgaaacaaaattagcccaaatcggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctttatttaaaagcggggatgaattgattgtatcctccgatttatatggaggcacgtaccgtttgtttgaaaacgaatggagaaaatacggcttaagctttatttacgatgatttcagcgatgaagactgtttacgctccaaaataacggaaaacacgaaagcgctatttgttgaaacaccgacaaacccgttaatgcaggaggcggacattgaaaaaatcgcccggattacgaaagaagccggcctgcttttgattgtggataatacgttttataccccggtcatccagcgtccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccgtgaacttgcagaatttttagaacaggaagaggaaatcgccgacgtgttatatcccggaaaaggcggaatgctgtctttccggctgcaaaaagaagaatgggtcaatccgtttttaaaggcgctgaaaacgatctgtttcgcagaaagtctcggcggggtggaaagttttattacataccccgcgacacagacgcacatggacattccggaagatatccgtatcgcaaacggcgtctgcaaccgtctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtcccgatccagcatgcttccacattccatcagtcttcatttgaagaattcgggacatatgactacagccgatcaggcacaccgacaagaacagcgcttgaagaaacgatcgcaggtcttgaaggcggaacgagaggttttgctttcagctccggtatggcggcgatttcgacggcgtttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcccgcgccatccggccgaacacgaaagccatttatatggaaacaccgtcaaacccgacgctcggcatcacggatattaagggcgtcgtcaaactggcaaaggaacacggctgtctgacataccttgacaatacattcatgacgcctgctctgcagcgtccgcttgatctcggtgtagatatcgtgcttcacagcgcgacgaaatttttaagcggccacagtgacgtgctgtcaggccttgccgccgtaaaagatgaagagctcggcaatcagctgtataagctgcaaaactcgtttggagcggtgctcggtgttcaggactgctggctcgtattgagaggcttaaaaacattgcaggtcagactggaaaaagcgagccggacggctgagcggctggctgcctattttgacgggcatcccgccatcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgctgtcgagtccattctctcataccctgcagccatgtcgcatgccgccatgccgaaatcagagagggaaaaacgcggcatcacagacggccttctgcgcctgagcgtcggagtcgaaaacgccgaagatttagaacgcgacttcgaacaggcattgaaaaaaataacccccgcccaagtgagatcataaacgaaaagggcgccgtcaattttgcgacgcgccctttttttatttttgataaaaaaagtgttgacgaacggctggtcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgcagcaagggttttttactttctcttaatatagccggtttatcaaattcgcaagttgttggcaaactgttggcgaacttgattttttggctcgaaatttattgttcgtatctcttattagggtcaaaattgttgaaaagttcagctgttgatgccgtcaagtagatccaaaccgcactgtcggtattgcatttctatccggccacaaacttcggtatcaatataaaaaggccctctcataaaatgggggccttcagtgttcttttaaatagcttcttttagttgttctattacacttttcaaccattctataggtggtaagccaattgtcgggaaatatatttctgcattacactttataatgtcttccttttcttctatagttaaatcgctatttagaaactcttcgcaatactttactgtaaatagcagaccttctttactaatttcctcaataaattcgtctaaggcgtgttcaggggattggatatcttgatgaaatgttgcacctaaaaaattttctaattcatctaagaaatcatacctttcatccatgatacttcctctctttctatttggttggatatcctgtaaggataaagttaccgttattatcttttttgagtataatttttgcgtttgtaacgttttctactagatctgaatttcttgatacacttctgccgattatttctccatcgcccttgtatcttaacattaatttaggttttttaggatcatcaatccaattttcgattttctttatattttttggatcgtttaaaactgaattagcaattctttcagcggtagccctatctttaaaagtagatgaagctgtaatatgtgggttaggatcagttttcagtctttctattaattctttatctgttttcccaacatgcctttctagaaggtgtccgccttttgcttcgtgagcagctaagccaccgcctggtgcgagaggactgctgtctccttgtttaacactatgtatgccgttattgtcagaagtcacagatttactgagcacactctctttctgatcttcaataatacttttcaacaaaggcgtattcttcacattgtgagtattttcaatatcctgtgctattccggcaagcgcgggttggtacttatttttcgaaacggaattgatataattttttcctttttcaatcccggtttttacatgttttgcagctgctttttcaccagcttccaagacgttatccactttggcggcgcctgttttcgcgagcttgcttgatacttttacagctgagccggaacctttgagcccgacgatgctcccgatggcgtaagtgatgtaatgggatcttgaatacgcatccccgttaaccattttatcattccacgaatccgccaggtttgtccatatgatttttgcgtaggagggcgtgttcaatacagccgatatggttttagcgactttttgttcatcggagagatggtaaaaatcccatgcgccgacagccagatctttgacgccggttatggtgtcttttcccacatcataaaggccgacgcctattcctttgacgatatcccaagccgtttctccgacttcttcaagctgttttgcttgttcaagctgcattacatattccacctgagcgggttcaaggttttcatagccgatcttctttgcgatttccaaatactcatccggatcggtgacaccatcagccagctttttcttcagatccttgatttcacgctctttcgcttcttcctttttaatcgtcaaataagcatccgaatgtcttgcgatatcgccttttttcttatggatgtcgctttcacggtacgctttggcgttgtagtgaagcggcgtggcgctttttcctttgcctgtggcgttttggagctgctgaaagtcggcttggataaactgttcgttcgcttcggtttctgcgtattctttcgttagatcgtgatcaagcttgccgagtttatgtatggtttcgcttctttttttgtcagctgaagaaagcttttgatctgtgctttcggttgaaaacaattcgagcgagatgatgtcttcgatctcaccgaggatggagcgcatgtcttttttctgcgcttccataatcgcctttgatttactgagggcatgggtgagctcgtgctccagaaaagattcttctacatgagattcggaaagacctgcgtcttcgactttgccgggaaggcttgtgagaaatgcgattttcatatcgatcagatcaagccagctgtctgtgacgccggcgtgatcctggaaaaaggctttgatattgtcagcgccccggcctgagaaatcattgtcaccaagatcagccataccttgaaacgctttttttaggttgaccatctgaccgcgcagttttttatattcacccgcacgctgtttggcggcggcgaggagggtggttgcttcgaaaactttcatgaccatatcctttcatgcgaaatacttcaacaagatattaccatggaagaatgaaggaaaagccaaataagtattttgaaagtgcaaaatgattaatttgttctgggtaaatttacttattttatgatcgggaattggggtagagttagctttaggttgaatcggttgttagaacatcatgtgacgcacttcctttaaaaagcatacacacacatattagagggctgaaatttacccgaatgaattaggatacggcggcccaaactgctttccgcatggaatcaacctgggcaactggtcaatagctttaaaaacttcatcataacagggaagtgcggcgggcattgggaatataaaggaatataggcttacagctatgcaggatggatgaaaatccgtcagacggcgaaggaaaggcaatctccctgtgttgtgacagttcgaatgcgggggtatggaacttcccattcatccggagatatgtcagagggacgaagcgactttttgaggaggaagcggaatgattaaatttacacggccttcacctatgaagaaaacatgcacgatgcacccggaaaaggattctgtcagatcggtttcgtttactgattttaacggcaattctgtaacagtaaccctttgtcaaatgtgtctggctgaattaaaaatgaaagccgcgactgaatacaggagcatgaccgaggagcgggccaaactgaatcgtttcaagattggtgatcatgtgtatttagagcatttgggagtcgtcagcgagataaaaaacatggaaggcgctcaagtggcaaacaggacagacacagacggagtccggaaggctacccctaaggaaatcgcagaatataaaaaacaggggaagcgatgacggtgaaaaaacgactcagtcaattatttatcagttgtgttacttatgggagcgggggccggatgtttacgggtgcgcgacttacacggccggagcctccacggtggagaggaggagaattcaaactaagaatgtgaattgatcaaacgcagtttcatgaatcttcgaaggctttccatccgaaatttgggtgcagtatgggaaatttttttgtggaaacttgacataatgctgtcaggtccctattgtatgattaaatgaatggccagtaaaatgataggaggcgttcaatatgaaactgctgcaaattagactattggttaatgactttaaaaaaagcgtcgagttttacagagattcattaggacttccaataagttggttagagaaggaaatggaatatgcacttttcgataatggagaaacgaaaatagagcttttatctcaagaaaatatggctgaaatagttggagaagaaagaaaatctttagacggagatgcgcaatcgagatttttgcttcaatttaaggtagaagatgttgataaaacgtatgacaatttgcacaagcaagggattacatgcgtcaatgaaccacatgatcgtcaggaatggcgtgcacgagttgctcatttcagagatccagataataatcttattgaaatatataaaatgatataattttgaccggcgagattaaggtaatgcgtttgttaacttaccttatgatttttaaagtctgcaagagaaacatatataggtccaagacggaaagcctgcggacactgatcattgcacagctcactatgctctgattggtgtccgtttttatttgcacggagggataacaaatagatgatgaacacgaagcggacatgcaaacattcagtcgcggcaagggcggcgcgtttaataaggagaggaatcagaatgcaggatttaatcattcacaggaaatatattgactttcatcctgtttgtaatgttaattagaagatgtatacaaaatcattttaatgaggaggcatgaatgtgaaaaataaagcgggaatacaagttggactatgcattggacttttatgtttaagctttaccggtttcaatcctttattcggctctacgcacgctgaagcaaaatccatagaaaacacaaaaatgtcaagctgtataacgattcaaaaatttgttcagcttgagaaaaaatttgatgccaggcttggggtttatgcgattgatacggggtcaaacaagacaattgcctatcggccgaatgagcggtttgcttacgcatcaacttataaagttctggccgcagctgctgttctgaaaaaaagctcaaatgaaaaacttaatgccatcatccgctacagcaaagacgatttagttacatattctccaatcacagaaaaacacctggatacaggcatgagcctgaaagaaatctcagaagccgctgtccgttacagcgataataccgccgggaacctattactgcagcagcttggcggccctaaaggtttcgaaaaatcactgaaacagattggggatcatgtaacgaaagcggatcgattcgagacggatctaaactctgcgattcccggggatcgtcgtgacacaagcacagcaaaggcactggcaaccgatcttaaagcgttcactttgggtaacactctcacgactgacaagcgcacgatcttaacggattggatgcggggcaacgctaccggcgacgaactgattcgggcaggcgctcctgcaggatgggaagtcggcgataaatccggagccggaagttacgggacgcgaaacgacattgcgatcgtgtggccgcctgacagagctccgattgttttggcaatcctgtcaaaccgatttacggaagatgccgattatcataatgctcttatcgctgaggctgcaaaagtcgctcttcatgatcttaaataaacattgccgttcattttttatggacggttttttatatgttgagaatgcggtatgcgggtttcgatgttataatgtaaagccataaaatgatgggaagagggggagtttcgatgcattacataacggcatgcttaaaaatcatcagtgataaagaccttaatgaaataatgaaggaattcaaaaaacttgaggaagaaacgaacaaagaagaaggctgtattcagttccatgctcatccgctcgaaccatcagaacgcaaaattatgctttgggagatttgggaaaacgaagaagctgttaaagtccattttacgaaaaagcacacaaaagacgttcaaaaacaagaattaacggaagtagaatggttaatgaaaagcaatgtgaatgagtaaaaggctttgtctgttgttggctgactctgccggcaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagctgtttgctgtcaagacctgtataagcgtcactcattaatgggagcataattcctccaaaactggtgccgcggataaataatacgacggaaatccaaatcatacttgtgttatcggtgataagaataagcgggatagatccaatcagcgagagaacaagactgaccgtaaccacgtatttcgcaccgatcttatcaatcatttttccgatcagcggacgagtcacgagcattccgactccttgagggattaaagcgagtgctgctccgactgccgtgaaatgacgaatgtcttgaaaaaacagcggaagtattaacatcggccccatgatggcaacattcgctaagaacaacccgatcgaagatgctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgaactttgttgaatggttcaaagtctggaatggttttcatcataagcggtgcggcaaccaaaatgatgaacacgttgatgtaaaaaatccaatgccatgaagcgccttggacgatgaagcctccgatgacaggtcctaagatcgggccgaagatcataggggtgctgacgattgccatcacttttcccaggttttccggacctgccgttttaaccaagagtgttgacataagcggagtgataatgccggcgctgaatccttgaagcaaacggaagaagatgaagctggaaatgtcccggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgtcgtgttgaagtctttggtcagtttgtcgatggcgatgtttaccatcgtagagtcaagcatgggagcaattgctcccagtgcaatagcccaggcggctgtgagaacttcttttggcagcaaaagttcctttcttttatgtgttgacatattattctcctctcaaaattgctgtatttgtttccttgtcaacaaaataatagagtgattttgtttctttgtcaacaataagaaggatataaaaaggcagcccgttttcatggagcggggctgcctatggttttattccgatttcatgtctgcaccaagtttctttatttctgaatccaaatgcctgctgtatgtttccacgaagctcagcatcgtgtcaaattgttcatcagttacttgttcaaacacgattttgtcccgttcttgaaactctttgtgcaattcctcgtgaattttataaatgacttttccttgctcggtaagcctgaaatagatttctttcttgttaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatgacccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtggtttttcgagtatgtttctttccgtattcgttactagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacacttttgcggttgcgcctagtggatacgcatctgacagaacgctggagtgagcttcgggttcccagtaaaatacgccggttcctttgccgttcggaacggctttcaccagttttatggtgtcttttatggtccagtaggaatcttttggattattttcatctccgcccagttcaaccaccatgacttccttgttgtagcgtgaggcgatgtcattcaaattagatgataaatggccggtgagctcccagtacggcttaccttcccaatagggatagaatgaaacgccgatgatgtcggttttccctccgtttttaaagaattgatcaaaccaccatctgaataggctgttgtccgtgccgtgtgccaaatggctgattaccttggtggccgggctgacggatttcacggcgtcatagcctttgttcagtaagccggtcaatttgctgaaatcgctcgtgctgccgtcgggcagtaaaattcctgaattcatttcatttcctacttgcacccaatcaggagagatgccgtgatttttaagttctttcatgacatcgtacgtatggttatacacggctgcctgcagctggctgtttgaatagccggtccattggttcggcttgatctggtggccgggatcagcgaacacatcactgtaatggaagtcaaccattactttcattcctaacgcttttgcccttttggccgccgcaagtacgcctgctttgtcactatagccgagcatggtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatccgcgccataggcaaacggggcatccgcttttgctttaggagacttctcaagaaatgtaaaagcggtgaaaatgagagaaagacagattgcgtttacaaatacacgtttcaatcggtttttgaacatcacaatacctcctgataaaaaagattgttgattgatttcactctgaatgtttcagctgccattctccaataacgtcgtgaaacgatgaaacgcctgaattccttcgggtgtcattttaaaaacgcctgcatcggtcagcgcgcgtaaaaatacattcgcggtttctctttgtaaaacagcggctgcattttccggtgtcacgtctttatccgctttgatgttttcagcccacggaagatgaatgtctttgatgtcatgaggttcattcagtaaatactttttcacttctgccagctcatctttcaggcggggaggtaaaacggcgagccccatcacttcaatcagaccgatattttcttttttgatgtgatggacatcctgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcatctgaatattcccgccacttttcaaaaacatacgcagcggcatctgtcagcaaatccggatcttttgcgcgaaggcggatcactgataccggccactttacggcttcggcctgaacgtctggaaaatgacgcatatgaaaagggtagagggaacccgcttttgccatgggaaactcatgggcgccgccttgataatgatcgtgtgaaagaatggaacctcctacgatcggcaagtctgcgtttgatcccgcgaaataatgcgggaaaatttccgtaatggccagaagccttctgaagctgtcgcggctgatgttcatcggcttgtgtacgcttgaaagaaagatggcatgctcgctgtaatacgcataaggagagtattgaaaaccccactgttctcccgctaagtcaagcctgatgatgcggtggtttgaacgggcggggtgatgcggtgttccggcatacccctcgttttccatacagagcagacatttcggataccggttttccggactgttttttaccgcggcgatgtctttagggtctttttcgggctttgataaattaatggtgatgtccaattctccaaaaggtgttgttgagcggtacacgatattttttcgaatggcccgcgtcttaatatagtcgttgttttgactcaatctataaaaataatctgttgcttttttcgggcaatctgataacaatttgctgaatgcggcattgatcagagaaggggccggtgtgattacgtccatgattctgcttcccagcatgtctctttcagccggcgtatcgtttatgattgaccgttttaccgcgtctttcaccatttcgtccacatagtgaagcctgttttgtttcttgatacgtttcggttctgcataatccgtcagtccgagcagatcgagaagtctgtttcttgtataaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggacgctcttacttttatgtctctttcggtcacttgccgggccgcttccaccatttctgatacggaaaacccgctgcttgatcctaaattgaaaatgccgctgtctccgccgttttgcaaatattccagagcgagaatatgggcatcgattaaatcggaaacatgaacataatcgcggatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagtgagacatattttatgccgcaggcggtatcgcaccacttcagcattttttctgccatgagttttgattccccgtatgcgctttccggcttttccggcatgtcttctgtgatgggcgctttttcaggttcgccgtaaacagcggcggatgaagaaaacacaatgtgtttcacttcgaattcctgcatgacctccagcgtaatttgcgtaccgtacacattattattgaaatatgaaagagggtctttcattgattcgccgacaagggattgagcggcaaaatggagaacgcctgttacgttctccttcgcaaatacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcccggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcgtagtcatcacgtaacgaacggtgcgacgcattcatcagctccccgaacgttttcaaatcattcgatttgagagcttccgccgctgagagggtccgctcgttttcattgaccgcgtgccgggctcttttacgcaaagtttcacgggagagaagaggttcgagttcgttgaattcttctcccgtcaattccgcaagtgatgcgatattttgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaacagaatggccatgttctttttgcctttttgcactgcgaattgatccataatccctgaattcacgccgataaattcattttcgactctttttccgataagcgccagttcagtatcggaaacatccaggctgaataactttcttaaaatggaaccggttaacatttcaatggaagcagaggagcttaaaccggctccgtttggaatcgtaccgtgaaaaagaatatccattccgctgtctatttggccgccggcttcaagaaggtaatggatcatccccttcggataattggcccagccgtcttcttttttgtatgcagtggcggaaagatcaaggcagacaatgccgctgtcaggaaagttttctgagtataaccggatctggtgatcttcgcgttttgcgcatacggcatatgttccgatcgtgatcgcgcatggaagaacgtgaccgcctatataatccgtatgttccccgatcaggttgatccggccgggtgcgaaaaacagttctccgttacttctcttgaaaatgtcttcgaatcttgatttcaaaagtttggcatccatggtaaacctccgattctattttgaggtatgctccagtatgaactgaatggctttttgtgaatttctggtgagactgatatattccgctcctttcgttgcgatgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttcggtcagtgcgttcgcaagcatagcgctcgttcccgctccggcgcacagcactaacacattggtgccgtgttccaaggcggatgaggattcctgaagatttgtgctgatgacggtggccgcgtcttctgaggcgccggccattacgggctgtatctcccgggatttttgcggcgcggtttcaggttcggtatgttgggcttcttccgccgctaatactttgtcataagctttacagaatggcaggtatatcaggaaatcgacaatgattaatacagccgtcagcacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaaccgcggatgcttttccgactgctttcaattgcttggattttgcgaaaagcagaaagataaacggaacaacaagggttgcgccggttcctcccattgtgccgacgaagttcccgagtccgacggtcagcacgttggacgcctgctcgccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaacggcgataagagagaggagagagcctccgcaaacgatacattcagcgtattcctgatcaataaatcaacgatcaccatggccaaaacggaaaaagcgaacggaaaaacatctttaaatgtttgtgaaatggtacccggtacttctttaggcattttaatcgtaatatttttcagcacgcagaatctgtaaacgttcaccgttatgaaagcggatacaaaagcggctaaaagaccttttgtgccgagatattccgtggagaacccgccgtcgatttgagtgacgcttaaaatgagaaacccgacgactgaagcaagcatcgctgaaacggggttgatccctttgtttttcggcatttttcggttcattgattcactcaggcatttcgcacttgttgccgcaacgatcagaccgagggcgcccattgaatagttataaactttccaaagccattcagaaacacttttaggccaagtgaaacccaacacttccggcacagcggcggtgaggatgaaaatgctggcgaataaaataacaggcatggcagttaagaagccgtcgcggatcgcgcctaaataaatgtttcttgagattttttcgaaaaacggttttcccttttcgatttgcttgatgataccgttcatttttccactccttatcggcggcttcggtagagttctataaaatcctgaataagatcacggagcaaaagggttgtcatcaagtggtcctgaccgtgaacgaaaataaaccctaattccatgtccttgccgtcagcttcttcagctaacattttcgtttgcgcattgtgggcgagggttaaattttcatcggcgcttttcaatgctgcttccgtgttttcgaagtttccggcacggacttctttcaggactttcaataaagtgcttctggcgtcgccggcataggcgacgatttcaaaaccgagcatctgcaattcttcctttgtcatgaaaaaaacctcctaaagacggcacacatgatgaaaagagattcttttcaccatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaaatagtcgatccttgccttatccataatgatgccgtcttcaaactcatctttatagcccatgccgttttcggtaatgtaaattttgttatattgcggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataatggtttctccgtcgtacgctttgacgaaatggcattgataatgattgatgccgagataatcattgcgcgttgaggcttttttcatcacgtcaaagtcactgtctgaaaactcgtatgaagcgccgtttgcctcacagatttcatccagagcacgcatggtttcctcagaataatagccaaggtaggtggcatcgaggaggaatctcactgataacgcgtcatccagaaaacaggcgtggcggtcttcttctgtgccgctggcgggatattttgtttccaatgagtggacgaccccgatttctcccggataaccgccgtctttaaaaagattgacggtcatcgcatgcgctaccatcatgtgatggaggcattgaatgacttttgtgatatcacttttaacagatggcgggaaaaccccgagtaaatactggttggtggctgtgggataaatttcgttaaacgtgctccaatatctgatttcgctgaattctttaaagcaaaactccgcatagctgacgaacgcctctattgcagcgcggttgaggaaatctccctgatcaaataatcctttcggtgtatcgaaatgatgcagcgtgacaaaaggggtgacgttgcgtttatggcactctgagaaaatacgatgatagtaatcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacaggccctttgccgccttcttttgtggcgccttccgcttgatatgccgcagtcgccccgccgaaaataaagtcatgaggtaatttgagcattactgaatcctccttcgccaatgtgtgaattggagtttgttaatgtttgtaattgttatcttttgtttaatagtaaacgcatacatttttgttgtcaatagcttcataaagaaataacatctgtgtttatagaggttatataagtttttcgttgttttacatgttgattatgttgtttgttaatgtttatttttgttgaccggattgccgcagtatgttagattgtgtgtaaagttgaggggatgattgaacatgttaaaaaaagagcgacttttaaaaatcatcgatatcgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactcggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggaggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaattcaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgggccgaaaaccatttctgatgatgacattttcgttaacattcacgggagaacaaacagtgaaatcctgacgtattttatttccggcgatttaacaaatgaagaaatcaagaagctgtcttttgaaaaagaagcttactacagagaattatgccttgaaaacaaagatgaattaaagctgacgaagggactgaccggcgtattgaatcatctgaaaaaatctaaaacgccgatgaccatcgctacggctacggtaaaggaaaatgtcgatttttactttgacgtctttcatttggatcagtggtttgattttgacaaagtcacgtttgatgacgggagcttccccggaaaaccggcgccggatatttttctcatcgcatcggaaaagttaggcctcagacctgaagaatgcttggtcattgaagatgccttttcggggctcacagcggcgaaaaaagcaggtgcgggcaagattatggccattgacccgcacggaaaaaaccgcgcgctatttgaagaaaaacagctggcgggtgacgggatactgacagatttcacctcgttttttgaggtgattgccggacattctgtttgagagatgcagttggattgagagtgctttatgtaagatcttttgatgctatacccgaaaattaggatgttaaaaaacgctccctattcatatatgcaacagaaaccgaagtttttgatggggtattctttagttggcggtcaaactaaagaagtggttcaaggacataacagaaggagtgctaaatgaatatatttagaataagaatctgatttggataggtggaatcgcaaaaaatttaggagctttgcaaaacatttcaacagctgttcttaataatagggtttacagtgttgaaggtagaaaaagtcctatttagcaagccctcttttttaaaaagagggctttttttatgaggtgcttattctttttcagttgcgcttttgtttttgtataatgattttctcattgaaggcggcattttttgcatcagaaaggtgttcgccttaattgaaatattggctgaatttatagattcgcagagataagggagtcgtaaaagatatgccgtttgcggatttcagcctgtcttttgagaaggatcattcttcaatgacgcttatttcccccgtaccgaaaaaaagtgaaacacgttctcctcgcttttcataggttttgataagtccttcctgccctttaagtttccagcctttttcggctatttccaattggtataaaccgctcggaccttcttcttcttttgcgaaacggtatgtatagtttgaaacgtattttcctttttcatattcctttgttttagtgtgcatagcgaataatggcaccgggaaatcagggtgagaaacagctgctttatatcctcccaaaataaataagctaaataacaataatataaaaaaccacagaatatatttcataaaacctccttatgtcaattagtcggtgcattttaaaaaaagatacaccgcatgattgggttataaaagcgggtaagaagataaggaaaggagagagacggatggaacttgattttgtgattcgtctggcggttgcgggtctgcttggggctcttattggattggagagagaattcagggcaaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggcgtcggatttttaggagccggcacgattattttgcagcggcatgtcgtgcgggggcttacgacggccgcggggatttgggctacgtcggggatcgggctgacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgcctgatgcattgcgattgataacgcagggatatccatagcttccacctccttatcccttcatatcggcggcgtgctccgattatgaagagggctggcggtttctttttacggcccattctaaaagtgcggcagcgcataccccgagggtataggcgaaaatgtcactccagacaaattgccagccgaggatcagcccgccgagcgtgctgcttctgatcgcgtcaatccatggcgcgtgatacagctggctgcattcaatcagacagcaaaacgagaggctcaaaattgcggctgtttccgtccggatgtgccgtaagaaaagcccgaatcctgtaaaaatcatggccgcccacaaggcatctcctaaataagcgtttatgatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacgacggagaagctgtctatgaaaaaaacggcccgggaggccgcttttttgcgttatctggcttttaggttgacatgatctgctttttgatcactgccgatgacgaagcggagctcatactgccccgtatggtagacgtaatctgtttcgcccgtttctggcactgtcaggattttgtcagcgctgccgatttgtttgcttaagacgtcaggtgtgacgctgccgaggtttaagcgccgctcgacccccgttccaaaatagcgtatttccgagatttttccgtttttatgataggaaaatccatacccggggtttcccatgttccagctgtataaatcaaatggattgcggctgtctgctttttgttccggctcgccgattttattataaacgtcctgtcttgtgctttggttgattttcaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaacgagatgttttagtgaaaggccggttgggaatcatagaggatgtatagaggggtacagaaaggggaaagaaaatggctgatacaaagaaagttacaatcaatggggttgaaatggaagcgccggacggccaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcattgatacgctttcgtccgatgtaaaaaaagcgcaggttatcggcatggacaacattttgcacaaccatgaattgtactgtacggtctgtgattacaacaatgggagctgcgaaatacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaacgttaagcattgattgggagcggaaacgcccgcgggtcatttgggatcaggatgtgccgatcaatgaatcatcatgtgtttcctgtggacattgttcgacggtatgtccgtgcaatgccatgatggaaaaaggcatggaaggcgaagctgggtatttaacaggcatcagccaagagacgcttcggccgatgattgatatcacaaaaggcgtcgaaaccggatacggatcaattttagccatatcggatatggaatcggccatgcgggatgaaagaatcaaaaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcgtttatcacatcttccaaatgcacgaatgaagaatcatacgtgatgcagaagcttgcaagagccgttatcggaacaaataatgtcgacaactgctcacgctactgccagtctcccgccacggccggattgttcagaacggtcggatacggcggtgattcagggtcgattacagatatagaaaaagctgagctcgtgctgattatcggttcaaatacatctgagtctcaccccgtcctgtccacacgcattaaacgttctcataagctgcacggacagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagcgtatgcgcactgtgggcgatgggggtcacccagcatatcggaggaagtgatacgagcacggccatttccaacatgcttcttgtgaccggaaattacggcaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatgggacttgtcgactccaatatcaaccatgttcatgccgcctttgaaaagcttgatttcttcgttgtgcaggatatttttctctcgcggacggccgagttcgccgatgtggtgctcccggcaagcccgagccttgaaaaagaagggacgtttacgaatacggaacggagggtgcagcgcctttacaaagtgtttgaaccgctgggcgattcaaagcctgattggcagatcattacggacatcgccaaccggctgggcgctgattggcgctatgaacatccggcagacattatggaagaagcggcaatgctttcgccgctctacgcaggcgtcacttacgaacgtctcgaaggctacaattcactgcaatggccggtagcagcggacggaaccgattcaccgcttttatttacggacaagtttccgttttcagacggcaaagcgattctatatcccgttcagtggaccgagccgaaagaatttgatgaagaatatgatatccatgtgaataacgggcggctgctcgagcattttcacgaagggaatctgacttaccgatcaaaaggaatatccgaaaaaacaccgagtgtgttccttgaggtctcgcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgctgccattaaccttttgacaagcagctatgcggataaggataccgatacaccggcttataaagaaacatcagcgaagatggagattttgaaaaaagaaggcgttaatccgcttccgaaaatcaatttccgttacggaaacccgcagccgcagatcggtgtccgggttgatcggaaatgggcgcgtcaagattatgtatttccgggagacgccgtaaaaagggggaaacagcagaatggctaaagcaatcagcggcatccgaaaacagaccgtcacagaagaagacaaacgaaaaaaggacttagaagagatcgagacggctcttttacgaaataaagacgcgattttggaatctctgcacattcttcagcacatgaacgagcgcggcgttttggcgcttctgcgcgggctcttcggccaaggagacaaagtgatggatatcctcgtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacagggtattttgatatcgtccgcgctttaaaagacccggaaatcaacaaggccgtcactctgctgttttcttttctgaaaggcatgggcgctgatacggacgatatggaaaggaatacgcagcctcctgaagaccaaaagcagcatcagaaaccgcagacgaatgagtgaacatttctcccgagcctggccgaaggctcgggttttttgtgcgcttctgctgttttcttgggagaaatttcacctccggattcatgacttttgttgtgttatgttaatagttaaggttatgaatagaaaaaaattgaaaatatgtgctaggataaaattcaaggtacgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgggaaagccctatatactttgatgaagaaacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgcgtcttgaaggaatgggagccgagaattaaagacattaccgatcatctcctgaaacaggcaaagaacaaagggcggattgatatcgttaaagatctctcttaccctttgccggtcatggtgatttcagaattattaggcgttccgtccgaacgtatggatcagtttaaaaaatggtcggacattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagatattatttctattttgataaaagaggaagaagagggggagaagctcacgccagaagatctgatcccgttttgcaatctgcttttagtggcgggaaatgaaacaacgactaatctcatttcaaatgcggtttacagcatattagagacgcccggcctttatgaagagctgagacaggacccttctctcatcgcgcaaacagtggaagaaacgctgcgttttcgcgctcccgctccgtttgtcagaaggacggtccggcacgacactgaactgcgcggccgtcgcttgaaaagcggagagatcgttctctgctacgttgcatctgccaaccgtgatgaaaacaaatttgagaaggcgggcgtatttgatattcatcgccaatcgaatccgcacctttccttcggattcggcgtacacttctgcttaggcgctccgcttgccagacttgaagcggaagccgcactgaaaggaattgtaaaagccttttcacaccttgagcccgtccggattgagccgatccgaaacagtgtcatgtacgggctggagtctttagaagccgagataaacgaaaatgagggagaagaaaaaagatgagaaaaacacacatcgccattattaatgtggccgctcacggtcatgtcaatcccacgctgcctgtagccgaggaacttgtcaatcgcgggtataaagtgacattcgctacgactgaggaatttgaagcttccgttgccaaaacgggtgccattcccgttttataccgcacaagcataaaggcggacccgaagacgataaaagaacgggtaaacaaaagtgacgcgtttgtgatgtttctggaagaagcggttgaagtgcttccgcagctggaagagctgtacaaagacgaccttcctgacatcgttttgtttgattttttagcgcttgccggaaaattgtttgcggataatggcggcatcccggccgtaaagttctgcccgagctatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggggaacgcacaaatacgggaagtctggaaattgatgcagccgatgaccgtccgcttatgctcatctcactgggaacggcgtttaacgcctggcctgaattttaccggatgtgtattgacgcgtttcgggactcgggctggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggtcaccgcaaagcgtgtggatgaattggggcttggcgtgcatctgccgccgaaagaagtcactgtggcccgtctgcaaaaagacgttcagaacgtatacggcgataaaaacatcctcagccgcgtgaaaagcatgcagcagaaaataaaagaaaccggcggtccaaaacaggctgtttgcgccattgaagaatttttgaaaacggcgtccgtcgaaaattgattaggaaaacaggcagcaccggacggctgcctgttttgttatatgtttttcttcatgccgcatctccggcattccctcaaaaattttccgcccttcactgagcttttaaacagcgtgtagtcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgcccggttaatgatacagcaactgcacgggggattcaacgggagcatagcttgattttcccggctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcggtcatccgttccctccaaggaaccgtatacctggcggaggatcaaatggaacccgacgtaagaacatttgccgagcaaaaagccgactgggtgatattcaccacaggcatcggtacggaaacgttattgtcggtatcggaaaaaatcggtctgaaagaagaatttttagcggccgttcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagttatgatacagcttcatggcgaaaaagcgccggttttaacggagttccttgagaaaaacggagcggaggtattccctgttctgccgtatcagtatattccgcctgaaagggagacggtcgataaactgatgggagagctgttaaacggagaggtcgatgccgtatgttttacgacagccattcaagtgcgctctctctttgattatgcaaaagaaaaaggatccgcaaaagaattgcagcaggcattcgaaaaacatgtgcttgccgccgcagtcggcaaagtgacggctgaagcgatccgggatgaaggggtaaagagggtccttgctccggacattgagcggatgggagcgatgataattgaattatcccgttactatgaatctctgaccttgtcataaaccaccattcagcagggaaaaaagcttacgcttccctgctgaatttttttaattgccagtgttccgtgaaaagggaaggatatgtcaaggcgctgagtatgatgcatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttctagcgtcgggatcatactgagtttcatactggacgtcaatatctgccggacggcctgcttaggcgttcctccgagagagagaatcagctggatttcttctttccgcaggtctgcttccgaactgagccggcttaaaaacagacttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgagccgatccgcatttttttccgtttggcgacattgtgcgaagcggccgtgagcataagaagcaccattaatatgataaatatcgggtgatcaccgcgaaaaatcagcgacagcacatagccgatgatgagaagctgaatgacggccctgacggttgcgacgatcatatccttttcgacgccggctttaaaagatttagacaggaataaagcgataatgacaaatatacttgttagtaacagtgaaagatcattcatatcagcacccgctcccttgtaaaagcgcccgggctttttcgtgtttcggttccttaaagaacgttttcgtttccgcggtctctaaaagccgtccctcagccataaaccataccgtatcggataatcgttccgcttgttcaaggttatgggtgatccacaggattgtcagctgtttttgccgatggagtttcgtaatcagtttctcaatggtgagaacggatgaggggtcgagcgccgaggtgatttcatccagcagcaggatggacggcagtacggcgagagttcgcgctaatgagagtttctgccgctgacctccggataattctttcgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagcacttccccttcatcaggcgtattcatcagattgcaaagtgacagcaatgtgctttttcccgcgccggaaggccctatcaacgccgtgatagaacctttttgaatatgtccggttacacggcttaggacatcaaaggacgtattgttttgttcaaagcgtttgccggctgacagaaaagatattgccggaatttcttctttcatataggatgacacctttcgtaaaaaatcaggaaccggtgagattggctgacgtttgctccgcctttttctggtctgtctgccgggaagcgaatgtatgcatgaccattcccgcaataataatgaacagtccggcaaatgaaagaagtgacggaaacgccgcggataaaaagacgatttcgccgatcagtgcaaaaagaacctctccggattgcgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctataccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgacgacgaccggcgccacgctgaatagtatcgtgcggccggacagagaacccgcatgctgaagctgaatcagcccggctccgatcaggatgatgacggaagtaaccagcgaaatcagcgggatcttttgtctgacggaaaccgggcccgccggtgaattttttgtttcgcagaaaaacggcgacagaagcacacccgcgacaattgtaatctgccacgtgccggcgatcagccagcccggcccatatgccgccgcaaacgtaatcggggcataaaaaagcacgaacccggtaaaactccacttcagccaaaaaaacggctttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcaaaaagaggatattcaagtgctttatttcgaagatgacggccgcattccgaataacccgaatcttccgcttgttatttataaagcggtatttaatgaagaaacggtacagaaagcagagtccgtcctcagccggcacgattggtcgaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggccggcaccggacataaaaaactgtcgggcagttctgattttaccgtgatcggggcttatccgggcggccggcagtacgatacaaaaacggagaaaaatgatagaacttcagaagaaatcagccgtgtcccgctcccggaatgtgacccctttacgggaaaaacgggcccgcttttaaaactgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcgtgcttttctgcatgaagggggaaaggctaccctttccaaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgcgatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaacccttgtgaacaaatacccgactcaccaaatcattacggaactgcaccgccttgcagccggcaacgtgtctgaacaggctgttgctatgccgctggaaaaacttctgaaaggaaaagacgttgacattaaaatcgcagaagtcaattctttctcagttgataagaaagaagttgccctttctgacggttctaagctgacttatgacgcgcttgttgtcggacttggttctgttacggcttatttcggcattcctggactcgaagaaaacagcatggtgctgaaatctgctgctgatgccaacaaagtatacaaacacgtggaagaccgtgtgcgtgaatactctaaaacgaaaaacgaagctgatgcaacgatccttatcggcggcggcggcttaacaggcgtcgagcttgtcggtgagcttgctgacatcatgccgaaccttacgaaaaaatacggcgtagatccgaaagaaatcaaactgaaattagtagaagcaggtccgaaaattcttcctgttcttcctgatgaccttatcgaacgcgcgacaaaaagccttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagcctcggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcatacagaagacattgccggacttttctcggcaatgtcttttttttttgcataaaaatgtcaatggatacaattttctgaaaaataaaataaaaatgattgatatgtgagaaagaggaagctaaaataaaaaagaaccattttgttaacgttaacattttttaagagggaggatgagagtgtgaaagcttttatgggtgatgactttttactggatagtaaaacggccgtaaagctgtaccgggaatacgctgaaaacatgccgatcattgattatcactgtcacttaagcccaaaggaaatctatgaaaataaaaccttcgcaaccattacggaggcatggctttacggtgaccactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacggccgcggcaatttggaaaaatacgaatgagctcctgcagggagacgggtttggcgcaagggatctcattctgaaatcaaatgtcaaagtcatttgcacaaccgatgatcctgccgatgcgctgacataccatgaactgttgaaagaaagtgattttccggttcaagtgctgcccggatttcggcctgacaaaggtctggacatcagcagcccgggttttgccgattgggtccggtcgctggagagcgcttccggaatggctgtcaccacctaccaatcgtatttggatgcgttggaatcccgcgtccgcttttttcacaatgccgggggaagagtgtcggatcacgcattagatcaaatggtttatgccgagacgaccgaagaggaagcggcccggatttttgccgccggattaagcggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaacgtatcgcaaaaccgcttgcccggctgttagattccgccgaaaaaaagcggcaattgcctaaaacgattttgtattctctgaatccgaatgacaactatactatcgccagcatgatcaacagctttcaggatgggaaaacaccggggaaaattcaattcggcacagcctggtggtttaatgacacgaaagatggaatgcttcaacaaatgaaagcgttatcaaacgcaggtctgttcagccggtttatcgggatgctgacggattcaaggagtttcctgtcctatccccgccatgaatacttcaggcggcttgtctgcacgctgatcggcggctgggcggaacaaggcgaagcgccctgtgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgggggaaattcaggccgtacttattattcggaagtattattcttgcggtcatgaccgtattgatttttgtgtcaccggacgtgagtgtcacctggaagcttgtgtacgcctatgcttcttacatgctgtggggggtcgcttattctttcgtcaatattccgtacggctccctcggtgcagccattacacaggatgcggaggacagaacggcgctttccgcattccgccagatcggctctctcggcgcgctgctcattacaagtgtcatcgtcatcccgattctcgttcattttgataacgttcacatcggctacccggcagttatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatacaacattaaatccgctatgcttgtttacttcgcccaatacaatctcaacaatgcggagctgatgtcctacatgagttttatcatcatcggctcttcatttttaggtgtgttgtttatgccgaaactcgtcaaacgcttcggaaaaaagcaaacggtgatgatcggttttgccgtcagcgccgcggctgatgcgctgaatttctgtctcccgtcaaatgtatatatctttacggcgttagcgagcattgcttttatcgggatcagtataccaaacggcattacgtgggcgcttgtgtcggacattattgattacggagagtggaagacgggtgaacggaaggaggcgacgacatattcgcttttcaacttctccagaaaactcgcccaatctttatcaggttttctttcaggcatcgggctgagcgttatcggctatatcccgaatgcgtctcagacaaaaggcacgttaatcgggattaaagggcttctgctgctgtacccggctttcgctttagcgtgcgccatgctgattatcggtttaatgtataaactgacggaccggcagcatgccgagctcgttcaggacttacatcatgcaaaacctcaactttagtgattttatggactgtccgttaatgatacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacaaaaaatattagagctcgcttcacagctgaattacacaccgaatgtaaatgcaaaaagccttgccatgcaaaagtcccatacgatcggactgttttttacaagcatcacaaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcagcttctcagcggaaagaaggctatttgacatctttaattgatcattctattccgattaagcatgaatacagtgtaaaaggccgctatgatatggagagcggcagtcaggcgatggaaaaactcttggcgcttcaatcaccgcctacggctgttttttgttcaaacgatgatatggcgatcggggcgatgaataccattttcgccaaaggcctgaacgttccggaagatatatccgttatcgggtttgatgacatcggcatttcccaatacatgacgccgaggctttcgacagtaaaacgcccggttgaaaaaatcagcatactcggcgcagagaagattttggcgcttatcaccgacccggatacggcggcggaaaaaatatacgaaaacaccgaggtgatgataagagattcaattaaaaaactcacataacggcccgtctgattatccgggttttcgtacggaaaaatgttaacgtgtgcataaatgcagaaggaggcggacagcttgcggcagctgaataaaaagatgtgcggtgaatacattcaatatcctgaaaaagtccttcagttcggcgaaggcaactttttgcgggccttcgctgactggcagatcgatcaattgaatcaattgacggattttaacggaagcgttgtcgccgtacagccgagaggctctgagaaaataaaacgtttaaacgaacaggacggtttgtttacgctttttttgcgggggttaaaggatggaaaaccggctgaagaacacacgatcgtcaaatccatcagccgcggcattgatctattttctgactatgattcctttaaacagctggcagcacaagaggatcttcgttttatcatctccaatacgacagaagcgggaatcacgtctgagaaaggcgaccggcttgaggataggcctcaaaaaacattccccgggaaattagcggcgttcctttatttccgctataaggcatttgcgggtgacgccgagaaagggtgcattgtgcttccatgtgaactggtcgaagaaaacggacggaaactgaaggctgccgtgcttcaatatgccgggctgtgggagctggagcctgattttactcaatggattcatgatgcgaacatcttctgcaataccctcgtggatcggattgttccgggatttcctgttgataccgcggaagaacttaccgattttctcggatacgaagaccgtctgcttgtggtcggtgagcattattatttgtgggtgatagaaggcccggaacagcttcagaatgagcttccttttgctgaggccgggctgaacgcactgatcacgtctgaccttacgccttacaggacaaaaaaggtgagaatcttaaacggcgctcatacggcattggcgccagtggctttattatacggactccaaaccgtccgggaagcggctgagcacgaggtgacgggcagattcatcgaagaactgatcaatgaagaaatccttcccgtgctgcaaatggagggtgtcacccagtatgcggcagatgtgttacaccggtttaacaacccttatatccaacattatctgcaaagcatcacccttaacgccgccgcaaaattcaaaacaagaaacctgccgacgctgaaggcttatatcgaacaggagggccggcttcctgagaggctggtgttttcattcagcgccatgatctattcatactggaacgggccgaacaaaccggcagacggcgaggaggttctgaaccgttttcaaatggcgcggtcccgttgcaaagatgatatgtttcaagcggcattttctatattaggagaagagcgattgtggggaaagaatctgaaccatcttccggggctgactgaacgaacggctttttttctctctgtcattcataagcgggggatgaagcatgcgttacatgaatgctgcggcaataagggggaagtggaatgaaagaggtcataaaaatccataaaaacgataacgtgcttctcgccatgcgccattttaacaaaggagagcggctgcatacagacggactggcgattgaagtgaaggaccctgtaaagcgggggcataaaatcgcgctgcaaaccattgaagaaaacggcagcatcattaaatacggtttttcaatcgggcgtgcgacaaggcggatttcggccggcgagcatattcatacccataatctgcaaacgaatttatccgatgtgcaagaatacacgtattcaccgcgcttcgaggacaatccttttacaaatgagaaccggacatttaaaggctacaaaagagaaaacggtacatccggcgtccggaatgaactgtggatcgtgcctacagtcggctgcgtaaacggcgtcgctgagaaaatcctgcagcgcttcgtaaaagaggcgaaagacattgccccctttgacaatgtgctggttttaaagcaccaatacggctgctcccagcttggcgatgatcatgagaatacgaaacaaatgctgattaacgccattcgccatccaaatgcgggtggtgtgctggttttagggctgggctgtgaaaataatgagctggcggcaattaaggaaacgctttctgaagtgaacggagatcgggtgaaatttctcgaatcacaggctgtcacagatgaaattgaagcggggacagcgcttcttaaagagatacaccttgcggcaaagggagataaacgtgaggagattccgctgtcagaattgagcatcggattgaaatgcggcgggtcggacggtttttccggcatcaccgcaaaccctttattagggagattttctgattacttgattgcacagggagggagcacggtcttaacggaggtgcctgagatgttcggcgccgagacgattctcatgcagcgtgcggcgagcgaagaagtgtttcataaaacagtccgattgatcaatgatttcaagcaatattttatgaagcacgagcagccgatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaaaggattgacactgctcagtgcgcccggcaatgatttaatcgcttcttcagcgctcgctgcggcgggctgtcacatcgtgttgtttacaaccggaagaggcacgccgttcggcacatttgtcccgactgtgaaagtatcaacaaataccgatttatttcaatcaaaacctcattggattgattacaatgcgggcagattggcggaagaccaaacaacagaagatcacattgtgagagattttattcaatacattattaaagttgcaagcggagaatacgtcaataacgaaaaaaacgattttcgggagcttgcaatctttaagtccggtgtgacgttataagagaaaaggcgatctgacaacagaccgccttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcaaaaaggcatgtgcgatatccgttcccaccacttctgccgttttcattctgaacaggtataacatggcgatcgcaaataatgagccggacccaatagatgtcaggccgacgatgaagccgaaaatgacgccgatcattatcatgagtgtccgcttttcttcaagtgttttttgctgccagcggttcggccgcagttttttatcgaaaaaaaggcgggcgataatggaaatggcgacaagggtcagcacgtagccgagcgcctgtttgataatctgctcctgatgctggtgaaaagcgggaaacaagtgaagaacaccgatggcggctgttgcgctgggaatgctcccgagcgccaagtagccgacaagtttaaattgaacggtgcgctgcttccaatgagaaacgacaccgaacagtttggtgatggagttatataaaaggtcagtgccgacggcgattgaggggttgatccccaaaacgatcagtaaaggagtcaaaagcgccgctcctcccacacccgtcaatccgaccagcgttccgacaaagaaacccataaacacaatgcttacagtcatctgtgtgcctcctgaataatcctactatttttatcagattatatatgattaagaggcagtaatcaattaaattttcggaaaattttatacagaacaaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtctgtcgttttttcagtacatgcttcagccagtttgacgaggtcagtttccgcttcttctttcggtttgttctggatagctgatccgtttccgtcgttaatgacgtttgcaaacataagaaaagaataaacgatgtgttttacaagttcctgagcggacattgatgtctccgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatgaagataaatcgttgcggatatccgaaattcgacaattgcggtctttttgcgttcttctttttctagcaattatgataaaatatgacatatctcggtcattccaaaaggggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcattctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcgcacgtttgattttctggaagaacacatgctgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactgttgtcaggattgctgctagttgctgtcgggttcagctttacacaggtgatcggccatgaaagccatttggaaaaccaagcggacggcacgttccatattgccgcacgcaaccaaacataacataaagacccttctttggaagggtcttattttttgcatgcgtatccattccaattttatccgaatgcagggtcgatatgctcaagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggcaccggaaaccgaaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgtattttgtctgaaggccgctgggatgaagtgaaggcgaagattgaaaagaaattaagcggaagtatgccggcgaaaaaagcctctatttcttcttccgcgtctgaataccatgtgaaaaaaggcgacaccttatcggaaatcgccgcatcgcacggtgtcagcgtaaaatcactgcaaagcatcaaccatatcaccgatccgaatcacattacagtcggacaagtgatcaagctcgctcagacgggttcttcttcaaaaagtcaggctgtgtcttcctatccgcttccatccggtgtaatcaaagtgacgaaaccgctgacgaaagggacaaacgtaaaacaagtgcaaaacgctttatccgctctttatttttatcccgataaaggagcaaaaaatcatggggcggacggcgtttacggcccgaaaacggcatatgccgtaaaacgttttcaatccgtcagcggattaacggcagacggaatttacggcccgaaaacgaaggcgaaaattgaagaaaaactgtaatcaagaaaacggaagctccacgggcttccgtttcttcttacatacaaactgcggcaagggccttttgaatatcataaatgctttcatcttttttaaactgctttgagacagcgggaagttccgcgcctgaaatccaaattttcagctctgaatcaaggtcaaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcattgacattctcgccttccagcaaaatacgggccagttctgattttgcttcagccgtcgatattgtcgacgcattgcccagcaatccattgatgaaccccatgatatctcctccctgatacgtattctatcaaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcagaattgagccgggtgtcagtgagctggtgcaggcattttctgaccaaagctcaatttatttatttgaagggacgaagcggtgcgataaccgttctctccacttgacaagcacacgctttgacgagcctctggctttagaaaaagtgaccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcaggtgtaaatcccggcaacattgtcaatcggacaaaaaggaaaatggggctgcaattggaagtgagcacggcgcagagacacgcgctgttcagcaattttggctgccggggagaaaaatatacgccaaccgatctgttttttcggtatgtagaaaccgtgaaggccggtttttatgataaatgaacagggggcccgttcttacattcactggagctaggcggcgcatgaagtgcttggcgggcagcacggtgattacagcgtcatgatgcaaaaaccttttctccgatgtcaaaatgatgacattctgccggctgtgttcaaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcctgcgttttcttacctctgagactctttaatcttccgcctatcatccgaaatgacctctcttttttcaacaccctaagttacttatgattatagatacaaaatgtatcaaaagaaagggatgataaaaaaagtatcaaaaaggtcttgatgatacgaaatgtatcgtatataatcaacatcatagagatacaaaatgtatcaaaatacgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgagcgctatatacgtctgaagaaaaatggagacgtcccttatgaatcgtaaaagctacccgtttttcatctattccggattattgaattctgaacattatgacaaaatagggtccgccatttggctgtttttatggttcatcagctcaacgacaaaggaacatgtaaaagacggcataaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaaacactcgaaaagattcacgccgaaaaagacattaacccgcccggaagcaactgaccggacaatatcggcggatcaccgggacaaaaatgtccggagagaaatagatataacaaaaaatcatactgctgaagaagcgattaacgacattgccgcccattttatcagattaaggtctgcacaggaggggcggagcgtatacccgtcgccccgggattatcaggccatcgcccggattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcggggaggacaatcacaacaaaaaaagagaggaatacgatacatgacaaaacgaacgatcgagcagatactggccgacctgaaaaacggaaaacgtccattactggcggacagaccggaagaatcagacgaaagccgctttgactgcccgctctgtaaagatcagggcggttatctcaaaaaccagctgggaatggaagtgtgggtgaagtgccgctgcgccgccgaacgaaaagtagaacgcattctcggcgcaagtgagattacaaatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccggggtcggggaaaacccatcttttgaccgctctcagcaattatgtcatgagacagaagcagacaccggtgctgtattttccttttgttgagggctttacggatttaaaaaatgattttgatttgcttgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcctgtgacggattggtgcaggttgatgaagccctgggcacaagaatttatgagatgtgcagcgattatttagtcatcattaacggcaattcatttgacgtaaaccacagattagagggggcgagataatgtgtaagctgtgcggaccgaagaaggtcattgtgacggaaacgggtttcggcgctgtctttcacccttgcccgaactgcaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaaaacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctacggggagaaagttctgaagaaaaagaagcgttcataaatgagctcggaagcctcatacatgaagtgaacattttgaaaaagacggaggacgtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacgcgaaaaggggatctggcccgggtcgaatatgaaatcggctttaaattgaattaatcgaaaaaaacagaatacgtccaagacggaaagcctgcggacactgatcaatcgcgcacatgctgcgcattgattggtgtccttttttgttccgaaaaagaggaggatctacatggaagacttactatttgactataaacgcacgctgaaagagacgaaaaagtggtacaagcagctggaggaagccgatgaaacggtgcttacttcagaagaactgaaagataaaaaaatcatcagaacgattattacagatttggaatatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaacagacgatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacaatcggcagatggaaaaaagaagggcgctgggacgaggcgcttaaaaagaacgcggaaagcggcggaaaaaacaacccgggcgaaggtgatgagttaaacgaacgccagcggctgttttgtctttattatgtgaaatgctttaacgccacccaatctgcgataaaagccgggtattcaccggaaagcgcgcatgtgacgggaagcaggctgttaaaaaacgaaaaagtcgctagagaaatcagccgcatgaaaaaggaaatggtcaataaagtgtttgtcgaagcgatggacgttcttcaagtctatgtgaaaatcgctttcgctgacattaccgattatgtaaccttcggaaaaaaagaggttcaggccttcggaaaatcagggccgctctttgacgaaaatgataatccgattatgcaggagatcagctacgttgacgttaaagattcgcaccttctggacggaaccatcgtcacggaagcaaaactcgggaaagaaggcattgcaataaagcttgcggacaagatgaaggctcttgaaaagctgtccttgtactttgaccttttccctgaccaatttaaacaaaaaatcgaaaatgaaaaattaaagctggcacagcagaagatggaaaaaacagaagacagccaaaagccgattgacattgtcattacgcggaaagaggaacggccatgattgaaaaagcggttaacccgcgctttgaagattatttgttcaattggaatgaaacgtaccaatttctcgtcggaggctatgggtcgtcaaaaagctatcataccgcgctgaaaatcatcttgaagctgcttcgtgaaaagcggacggcgcttgtcgtgcgggaagttttcgatacgcacagagattctacttttgccttgtttgaggacattatcgaagagcttgagctgggacatgccgtaaaggccgtgtcatcaccgatgcagctgagattttcaaacggaagccggattatgtttaaagggatggacaatccggccaaattgaaatccattcatcatatttcactgatttggattgaagaatgctctgaagtgaaatatgaaggctttaaggagctgatcggccgtctgcgccatcctgagctttcgcttcatatgatatgcaccacaaatcccgtcggcacctccaattggacgtaccggcatttttttcgtgatgagcaaaacaaacggttcgtattggatgaccagacactgtatgaaaaaggcaccgtcgttaagggagatacgtattatcaccattccacagcgtgcgataatctgtttttgccgaaaagctatattaagcagctggacagcttacggcattacgatcctgatttgtaccggatcgcccgcaaaggacggttcggcgtcaacggcatccgcgtgtttccgcagtttcaggtcatggagcacaacgaagtaacggagcggattgcgtccatcaggcgccccctgtttcggaccggcatggatttcggttttgaagagtcatacaatgcggtcatccggctagccgtcgatccggatcaaaaagagctttatattttctgggagtattacaaaaacaaaatgaccgatgatcagacagctgaggagcttcaagaattggcggatcaaaaagagctgatcaaagcggattcggctgagccgaaaagcatccaatatttccgcaggcagggattttgcatggttgcggccaaaaagtttccgggctcaagacttcagtatacaaaaaagctgaaacggttcaaacatatctattgctcagacagctgtgaaaatacgatccgcgaattgcagaacttaacgtacgcaaaaaacaaaaatggcgttctgtcggaagatgagttttcaattgatccccacacactttcagccatttggtatgcgctggatgactatgacgcggcggatctgaaagatgcatcacaaaaacggagacgtccgaatcgggaaaggaggagataggcgttgcctaactatcaaaacgttagagccaccgtctttaaatcaaaaatggccgcgccgcaggcaaggcagatgaacgaagatcaatttgccgatctgtacggcgaagacatcatttcaccgccctataatctcattgaattgaaaacaatcgccgaatactcgacgattcttcagcagtgcattgacgcgtatcgggtcaatattacgggttttgggttcgatgtggaatatacctttgatgtaaatagcccagattgctcaccgtctaaaaaggcccgggccgaaaaaaactggatgaagctggagagcttttacaaatgtcttcattttgatgaatcggccgagacggtcctcggatatgcgatagaagaccgcgaaaaaacgggcaacggttttctcgaagtgcttcgggacggcgcgggaaaaccggcggggattgaatatctggatgtgaaacatatgcgcgtctgcggtgtgactgatcccgttgaagttacattttcatatgaagaaaacggcgcatccaaaacgattaaaaggcaaaaacggttccgtaaatatgttcagatgctgaacggacggaaagtgttttttaaggaatacggcgatccccgcatgatggacatgagaaccggtgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcacgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgtggaaattaaatcacttgcggaaattctgcaggatgatgcgctgtttcttgaatatgacgacaaaagcagaaataaactccgttccgctttccgtcttccgccgctttatacgggcgaggcgcaggaatacaacaaagccaccgccgatacggcacggaaaataacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataattttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcagtcaagcaatttctcgatcgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacacttgttgaggacatgctggcgccgattattaaacgcattgaagcgcttgaaaaagtaagaggcgcatcaaagcagccggaagaagagacgggcggccaagagcctgttaaaaaatcgatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagccttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagctagtcgtaaacggcgatacatcttcttctgatccgtacttggcacagcttgacggaatccgtaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggagccgcttcttatacaggacattctggaggcggaggcggaggcggccagaatggcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattctccggtttctgcacacgcaaaggtgagacctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggacaggcgtatattctggaaatgccgaagaaagcaagacagcaccattgggaggttatcgctgtgagagatgacagactatgaacataaaaaaccttgaacaatggaatcggtcgctgcaaaaggcatcatccggagaatttgcccgtcaggcaggcgaatggctggaacagtcaggagaggattttctcgacttggtacgggaggagcttattcattcgggcgggattgatacagaaagcctgctgtcttctttccggaaaggagcgcaggatcacgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctataatccgtcagcttcaacgggtatggcgctcaaaaaacagtggatcagcggaaatgggttttgggacaaagcccttcttttgtatgaaacactcttcgccgaatcgctggacaagcgtttcaatcagtggcttaacacgttggggggagatatccgatgaatcgcgaaaccggttcaatcgccgcttttttgtatcagcagtgcggcgtgcccgtatatgaaaatgaactgcctgaacaatttcaggtgccgtcactttacatcccgcccccgtatgcttttgacgagaatgacacagtctccacctttaagaagacatacagtctgaatgtgaagctgttccatgccgactcggtgcaggccctctatgcagccgacgggatcgccgatgcggtgagagaatcaagacagctgattccgctgcttacggaatcaggggaggataccggtgatttcgtccgcatcagccgtatcgaaacaagagtcggagacaaaggcgaggcagtgatcaccatccgctggacgagccgctactactatcaaaaacaaacatctcccgcactgcgggatgtggacattaacagcggggtgaaacaaaagtgaaacaatataaaaagaaaaacgccgcaacggcggaacgagcggttctttatgacacggcggatttaacaaagcacgcgaaggagcttttcggcgtaaaacccgagattctccagggtgctttattcggcgtgaagcaaaaacaaatgacaaaagcgcaagccaagtcttacattgaagcatttttaaccaaggaggtcatgcaataatgaacggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaggatttgaataaaaaagtggggctcagtattgaagatccatcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaacgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcatcgctcttcctgtcgcggaaaacgatcagctgaaagcgacatttgccgcattcattaaacgccttcgcgatgcgcagggacagaaagtgcaaggggtgaccgcccattacagcggggattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcctgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaagatcgtccgtgtgcttgatgcggtgaataacgatttgacacgtgaactgaaagccttaattaaatcgaaaaaaggcaccggaagcgatcttcctgcgacaaatgacggccttcaattcgtcaaaacgatgattattcaatatttgacaacgctccaggatgcgggcggcatcgctaactttgattcagacaaagacattacaatcgggctgaatgaagaccgcgacggctttttaatcgatctcgccgtacagcctgtggatgcggcagaaaaattctactttaatgtggaggtaaactaagatggcattaaaagcgcaaaacacgatttcaggaaaagaaggccgtttatttctcgacggagaagagatggcgcatattaaaacctttgaagcaaacgtggaaaaaaacaaatcagaagtaaacatcatgggccgccgcatgacgggacataaaacaacaggcgccaacggaacgggcacggcaacattctataaggtcacatccaaattcgccgtccttatgatggattacgtgaaaaaaggcagcgacccgtattttacgctgcaagccgttcttgacgacaaatcatcaggccgcggaacagaacgcgtcaccctgtatgatgtcaactttgattctgcaaaaatcgccggactggacgtagactcagaagccctcgaagaagaagtgccgtttacctttgaagatttcgatgtgccggaaaagctttctgaaacgttttaatcagaatcattgtgagtgaaacaggccttttacaggcctgtttttttataaaaaaaagagtaagggagttttcatcatgagcgaaaaaaacgaacaagtatatgatctgtcattctttatgccgggtaaaacagtcgaggctgaggagatccgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaatggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgcccgttttgaattggaagatcgggtttcaaagaaaataaggaaaatccaaaatggcttcagagcgcttgagaaatacaggaaaatgacaaaacgccaaagtgaaattgatatacgcaaagagagtaaatctgttttaagaacaattgaccgcatccagcgctctatgaaaagaaagctgggcgcacaaatgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaaaggtgacagcacagctggctgcaatgcaaaagaatatgccggacgtcggaaaagcttctgcatctgctgctcctgcttcgccgaaaaatgatttttcaatgcttgactccattgcagacaccttcatgaaaaaagtcaatgacatcgcatccaaattttatccggaaacaatcatagcggaactggataaattcgctgcaagctttatgaagaaagtggacgaaatcgcgagcaaattcagcccggcaacgatattagccgaactggacaagttcacgacgtcattcatggggaaagcggatgaaatcgcgagcaaattcagcccggcaacgatattagccgaactggataagttcacgacctcattcatggggaaagcggacgagattgcaagcaaattcagcccggagacaatattagcagagctggataagttcacgacctcattcatgggaaaagtggacgaaatcgcgagcaaattcagcccggagacgatattagccgagctggacaagttcacgacctcattcatggggaaagtggatgaaatcgcgagcaaattcagcccggagacgatattagcagagctggataagttcacgacctcattcatggggaaagcggatgaaatcgcaagcaaattcagcccggcaacgatattagccgagctggacaagttcacgacgtcattcatgggaaaagtggacgagattgcaagcaaattcagcccggagacgatattagccgagctggaaaaattcgctgattcgtttatgaaaaaggtagacggggtcgtgagtaaattcagtccggaagccatattgaaagaactggataaatttactgattcatttatgaaaaaggttgatgacgttgtcagcaaattcagtccggagaccatattgaaagagctggatcattttactgattcgtttatgaagaaagtcgacgacgttgtcggtaaattcagtcctgataagctaatcgaccgcgccgaacaatttgtaaatgacacgattgaccgaatttctgagaaattcgattttctcaatccggataagattctggaaaaagtggagcagtttacatcatcactgttcggaggcattgataaaaagttcggcaagttcagccctgatgcgatcatcgaaaaagccgaggcatttgttgataaaattgtcagcaagattgccaagaaatttgagaaattcagcccggacaaaatcatcgaaaaagccggggaattaatagaaaaaatattttcaggaatcgctgaaaaattaggcaaactcaatatcggcggattattaggaggcggcacgaaaaaagaaaagagtaaggggagcctttctgccggcggcaccaacagcccgaagcgtcctgagctgacaaagggtccgcagcgcacgggaccatcaccgaaatcttcaggaaggtcagccaaaaaaaccggcggggctttggggggctgctgctgctgtaccggagtgacgaggggcaaaagcagtaaagtcgaagggcggaataaatcttcgaaaagaggttcctccgtaaaggaaagcaaacaggcatccgtaaacacgccgaaaacaaaaggggcaggtaaaggcatcggcgggcttttgaaaggcttaggagattcaaaggcgctgaaaggcggtatgaaagggttaaaaggtgccgctaaaggaattcccggcataggtgaattgttatcacttactgatttagccggcatcaataaagataatgcaggagagaaggtcggctcagcaggcggcggtcttgcaggagccgcggccggagcggcaatcggcagcgttgttcccggagtgggcacattaatcggcggcgcggtaggcggcatcgccggcagtttaggcggttccggcttgggagaggcctttgattcaggggctttgaaagacacatggaatgatatttccgaagcggcgcaaagtgcttggacaacaatacaagatacttggggaagcgtttcatcctggttcatggattcttgtttcctcaggctccgtttccagcgcgtctaaaaagctgttgaccatcgccggaataaaatgcgcggtcgtcaccttttctgaggcaaacgcttcaatcatccgcacaggatctttctcccagccggccggaagcagatacacggaggcgcctgacatcgtccaccaaaacaattgccagatggaggcgtcgaatgaaaaggatgatttcagcacgataatatcctcttccgttaacggaaactgcccttgcatccctgataaaaaggcggcggcctgacggtgttcaacagccactcccttcggtgttcccgtcgaaccggacgtataaatgatataagcgagcgaatcagcatccgcttcgtcagagacagcccctgtctccgtctcacttgtcagagaagaaagagacgcttctagcgtttcaccggaaaaaccggaaacggataaccccggctgtgcaagcaggagacaagcgccgctgtcctcaagcatatagcgcagcctgtcctcaggatagtccgggtcaagcggcacgtaggcgccgcccgcttttaacacggcaagcactgaaaccgccatctccggcgagcgttcagcgagtacgccgaccatgctttctttgcggacgcctttttggcggagctggacagcgagcctgtctgtgtactggtcaagctcggcgtacgtcagcataccgtccggaaaacggagcgccggacgatgcggcgaaagcgcggcgcggcgggcaaacagcccgtgaagcgtcggggccggcggttcagccgtttctgtacggttaaacgcagttaacacccgtttcttttctttttcatccgccatatcaatatgccgaatcagccggtttggatttctaacggcattttcaacgatcgtcagcaaatgagtttgaattcgtttaatcgatgttttagtaaataaagcggattgataatcaaaattcagctcaatcaatcccgtatctgtccgctccttaattaaaatggacagctcatttgccgtatgcccgctgaaaaacatcgccgtttcataatcgaaaccttctgcctgacgccacgcgagaggctggtattgcatcgaaatcccgatgatattttgcaggtcgtgatgaatctgccttaattcattgacaaaaagattgtaaggatatttctggtgccgcataacagacagctgctgttttcctacactgcggacaaaagacacgaactccgcatccggatctgccgtcattctgatcggcagcgtgctgacgaacatgccgagcatatccttttcgagcttggaaccgcggtttccgtaataagtaccgatggcaatatcctttttagccgtcagacggctgatgcatatgtataacgaagccataaacagagagatgatgctgacattatgatctttgcaaaaacgccggattgattgttctaaggagtgggaaagagtgattgtatctcttgaagctgcagtgctttgtctaagatgagaggttcgttccgccagtgaaaggtgttccggaacggttcggtatgtttcagtccaaaatgaacggtctttttgaaaacgggaagactgtaagtattgctgttctttttccatgtagctgagataggaagggctttggtgttcggccaaatcctcgcttcgcatgattttttggtagatttcaatgagctgattgccaagcagattgagcgagatgccgtccataataatatggtgaaattttgaataaagccaaacttcttcgtctgacatgacaagcagagtaaaatgatacagcggtgaatgaaacagcttgaacggaacacgcgtctgtttgtcaatccatgcatcccgctctgattgatcaatatgagtaaaatcaacggtctctaaagaaatcggccgatgcccggccagatacagctggggttctgagccgtccccttccgtcagttgaaacctgagcgaatcattttgcaagatagagaaatctaaagcacggcgcaatacgtcaaagtcgatattccccctgaatttgacgcacgcagcaagattgcagatacttgtgcccggctcgagcagctctgtaaaccagactcttctttgggcgtgagttaaagaataaacagtgttcttcaatggaatccctccatttcaatttaagaggataagaaagtgaaataattacaattaaatttcgacagcatatgactaaatcatccatataagcattattttaaaacatattttagaaatcacaataaaaaattaaattttttctaacattttttagaatatagtatatattcctcacttcacttcttcatttctataatttttataccatgtaaaacagtatgtatgtacactgcaaactggttctaaaacactataataaggaataaaatgtataattaattgcgcttttaaaaaggttttgtcttctgaaaagaaattttatgataaaaaatgaaaaatcagtgaacaagtaagaaagtatcatgtaaaaaaaaggaagaatgttgccgatattactttttgaaaagattgattcataatcgcaatataatgttttacagacatcaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggtttttgctttaattttgccctctgccggagtattcttcagccggttccgaagagtgcctcccgtcattctgtcgcttgcaccggcgacagggagcgaacgaaggaaagccgggtaccacttctctttctgaaccgcatacaaaagctctccgatttggccggcggatacgccgttaatatgagaaacgccggatccgtctcttgcaatcaattcatccggattgagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattggatctgttctgattttcccttttacagttataccctgtttagtaagcgcttgtttccataaatctaaagcataggacgacggatcccacactgccgcccattctcttgcctttgccgagccggcaggtatggttccctttatcgtaatcacattgccaccgtgctcccgttcaaccgtcaattctttcttttcatcagaagcgacggtttttacttcatttttcacacgaacgatgtccgtatagggagaaattgaaatgcgcggctttttaccgggctgtttcgccgggctgatttccgcaatcaccgttccggtatcataatcctcatttggggaagcggtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccaatagggtcggatcgccttttcccctgagataaaggtttccgcgcagctgttttcctctcacggcgccgtctgcccgtacttctgtcttaaaggtgtaatcttctccgagaacggaaagcgccgaagctgccgtcagcagtttcatcaatgatgcaggcctcagccgcatatcttcccggctgccgaacagcacctcccctgtttttgctgaccggacactgacgcccgctgaagccccctttaaagcgggttcttcatccagaatgtgttccagctctttttgcaaagtatttttttgttcagccgccttagccgcatcatcaatataaggaacttcagcaatgatcaaaagcagaatcaccgcgcacaagcgtttcacatatgttttcaatgttatcccgcctctttcctattcttcgtcatgcaaaatggtgatcctggatgacgcagccgcttcttcgcccggtttcagaatctgaagccctgtcagtgatgcaggctgattcagattaaatgcatctgtaacggaagtataaggctcaagactgacaaacccctgctttccgtcaccgttatataccacccaatgcttgaaagacgtgtctgcctgatacaaaacggataatttctcattcggatgataaataacagcttcgttattgccgccattccgtccggaagaaagaaaaacatcgtcaaactgtttatttttcaaagacatcccatgacggaacgcttctttatcaggaacatccaataaacggcccgtcggtacgaaacgttcatttaattcccacatgcggtcagccgtcaaaaatagacgggatcgctcttcatcgaaaacaaatgtggaatgatagcctagcccccaagggaaagcctccgttcccttattcataatcagcgcccgctgcgtaaacacattgtcttttaatgtatagttcatccggacaatgacatcgtgcggaaattgtttatgaacacggggaatctttgaaagatcaatttctgtttcgactgtcattccatccccctcttctttcgctgctgccgctttccaatgctgattgtgaagaaagccgtgaatatgattatgtttatcctcttcgtttatctcgaattgatacgagcggccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaattgagcgatgtgcggtaaaaccttattgaatcagccgggtaatctgttttttcttccatacaaaccggtaatatccgtattgcagcagcaggctgacgacaaaagccgccggataaccgacccaaatgccaagaatgccgagattcgtataatgagaaagaataaaggccacaggcacttcaattccccaaatcgtaaaaatgctgataatcgtcggccataacaccgtaccgctcgcccgcattgttgctgaaacaatctgagcgtgaccgaaaatcagatagctccaaagggtaatcataatcagattgcgggcaatgcggagtgtatcctgatcggttaaaaacaaagccagtatctgccgggagaaggtgtaaatcagcacaatcaaaaccccgccgatcaaataattcaggccgattccgactttgatgacctgcttcagccggccgaattgattggcgccaatggattgggcggcaaaaattgaaacggcgataccgaggcttaccgccggcatctgcacataactcgccacttggttgacgaccccgtaagcagccgtcgcgtttgatccgtaatgattgacaaatgaaatgaccgcaatttcagaaagtgacacgagaatcatattgatgctcgacggaataccgagacggagtaaaagcgcgagcagctttttgtccattttaagagaacggagcgcagtccggtcaaatgccaagggatgtttccttttccgcaaataaaccatgagtacgataaatgttacgatgtttgaaatcacggttgcatacgccgaaccgtaaatgccgaacttcggaagtccgaaaagcccgagaatcaataagggcaagagcccgatgtttatgactgtactgacgattaacgtataaaacggagtctttgaatctcccgttccgcgtaaaaatgtcgtatacgcaaaatataaaaacatcagcggcattgcgcaaaacaaaatgcgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatctttttctcacgtcttacatggaaataaaccataaaaataaaaagtccggaaaatatttctgaaaaggtattgtaatcttaccgtaattattgtaacatttgtaacataagagaaagagattgattgaaggagagattatatcatgaaaaaatggctattattcctcactactattacattgattctgtcattgggcactgcggcgaccgcaaaaaatgcacctaatgaccttacacaaaaacaagcacttcagctggccctgtcagcgagagaacatttctggaacacgatgagcggcagtgcgcttaaatcaaacaccaattgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccggtcggcgacggagataacctcctgaattggaaaaaagcaaaaatgacccttctttctaaaaaaggaagcgttcaaacataccgcttcactgtaccgactcttgacggttccccgtcagcaaaacgcgatgtaacattcgtaaaagaaaacaacgtttggaaagtcaatcaatttgatgctgtcatataagaaaaagcccgcttgcttacagcgggcttttttcacatcatttccaccaggctcttgcgaaatattcaactcaaaaaccccttgtataacaaggggttttctgtcttgccgacattattaatccgcgcctatcttatacaaaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcacgcggcagctgcttcctttaatattctgtatgcctgaatccgggaaatgggcttattcgtccgtttcgatttaaacaaatagtcatcctctttcatgtcttttgtataagcgtatatgtcggcctttaaagactccagtatcagaatttttcttttctttctcgttttgctttcggttgcccacacatgatctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaaccccttataattggtaaagtaacatattgagcattatgttactattatagccgaaacctgttgaatgataaaggataaaggaccttatgtaacataatatacatagtgttacataaggggaataaggcacgcagtttcatcgaagtcttcaaaacatcattttcgacccgatgacgggattttaaatcaacagagactcacggtattaaaaaagaaaaacaacgcccttaaaacgaaatctgagcattcgtttttttgtgagcaaccgaaaaaaatgaaaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgtttcacagctttttctgcccggtttcccatttagcctatttgcgactgattacattcacacagaaactccggctttttgcgcaccggactattccgtttgtcacttgtgaaaacagcacattttacttactctataattgtaagcggaaaacaaaggaggcagactatgaaaaagaaaaagtttatgaatctctgttttatcgttctgctcagtactttgctcacggccggaagcatcccttatcacgctcaggctaagaaacacccgttttcctatgacgactacaaacaggtagatgtcggcaaagacggcatggttgccaccgcccatcctctcgcttcacaaatcggtgccgacgtgctgaaaaaaggaggcaatgcaattgacgccgcggtcgccattcaattcgcattaaacgtaactgaacctatgatgtcgggaatcggcggcggcggatttatgatggtttatgatgcgaagacgaaagacaccaccattatcgacagccgggaacgcgcaccggcaggcgcagcaccggatatgttccttgacgaaaacggcaaagccatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaaaacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatatcaaaaacttcaatgtgacgattgacgaaccgatctggggggattaccagggctatcatatcgcaactgctcctcctccaagctcgggcggtgttttcctgttgcaaatgctgaaccttctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgacccacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagtcgagtacggcatggatctgaaagcggcggtcgaagagccgagaatttacacaaacagcatgacatcctatagatatgaaaaaggagtgccggaagaagcccgcacaaaactgaacgaaatggggcataaattcggcagcagcccggttgatatcggtaatgtgcaaagcatcctgatcgatcgtgaaaacggcacctttaccggagttgccgactcaagccgaaacggagccgcaatcggcgtaaacttgaaacaatataaaaaataactaggcaaaaagcctcgtttctcaagctgagaaatgaggcttttgtttattctgcactgtattcagatgagggtttttcagatgttaacgaggcaagtgaaagcacgccgcacatcgcgatgacaacacccgctgatccgatccatgtcactgacgcaagagacagatgagtgacaacaatgcccccgatgcccgccccggccgccatagccagctgcatcacagactggttgaggccaagtaatacacccgatgattcaggctccatcgttgccaaatgatactgctgagcaggtcctgatgaccaggcggcgaaggaccaaaaaataagcactgccgccgctccgaaagcagaatgtgtgacaaacggcaataacatgagcatgatagcatgaagcgccattccgccggttaatgtcatacgcgccccccatttgtcagcactgaaaccgcctgctttagaaccggcaagacttgcaacaccgaaaataagcagcaatgtactcagtattccgctgccgatatgagtgacgttcagtaaatacggagaaaggtacgtatacgcaaccgaatagcctccgagccaaaaaaacgtaatagcaagcccgacagccacctttcgtttcttcaaaagagaaaattgctgaatgagcggcaccggtttatctccttttatctcaggcaacgcaaaacgtataataagcatggcaatgattccgattgcggcaattccggcgaaaaccactttccagccgaaagcttcagacacggttcttccgataggaacaccgataatgagcgccgccgtaaaccccataatgacggtcgcgagagaacttgcctgttttcccgggggagcgatttttgctgcgatcgtaagcgcggtgaccaccacagttcctgctccaagcgccatgatcacccgggctgccgcaaataatccgtatccctgtacaagaaatgaaatgatatttccgattacaaacaatccaagagcatagatcatgagcttccttctgtccagttttgctgtaagggccatcatgacaggcgttccgattgcataaacaagtgaaaaaatcgtaatcagctgccctgctgctgccacagtaactcccaaggaacctgcaattttatcaagcatcccggatatcacatattcagacgtccccactaaaaagctgataattgccaaaatgtaaatcttccaggtattttgcacctgacacactccttcattgatgatttatataaagatatattgtgatatatcgatataaagagttgaacaaacagaaacaaatcgcaatatgtcgatgtgtagtcggaaaaagaaactgaatccctcttctaaaggattcagccctacatttcgcgctgaaaataatcggccatcgcctttatcgcatcttcatctcttttataataggtgtatttgccaatccgttttgtttggataaggcctgcccgctgaagaatggaaagatattgagacgccgttgactgtgtcatccgaagcttatcggtgatctggctgacacatactccgatctcattcatatcaatgccatcatgcggtgcgaagtgacggtccggctctttcagccattgtaaaatctcaagccgcgactcattagacaacgctttaaaaacatcaataggtttcatacgctttattatatcgtgattttgcgatatgtcaatgttatttttcttgaatctctattttttgttttgtctctcttatgatccgggaaataaaatcactcacattctcttcatatgtgttttcccgcccgtattgccttacatgtacagaatgatggcggcactcttgatctcccacaaccgccatatacggtatttttttcatttgtgcttctctgattttatagccgagtttttcatcacgctgatcgagctcagcccggatacccgctttctttttgagaaaaaccggaacgaaaaaaaattggcgtacacagctgtcctgttttctcatcttctgttcgataatgtctttaatccattcagcagttcttcaaacgccgatgtcaaaaataaatcactccggtagatgaatgatatatccatattccgaaaatgttcagggagcttatgaagaaaaagatttttcctgttttgaaaataacggacggctgatgcaggcagaaaggagacccccatccccgcctgcaccgccccaataatggcttccaacgtaccgaattcaatgattttatgtgcgggcactgcctcttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgacttgctcaagatcttcatattcgaccggtccgtaaacaaaagcgccgtccagctcatagtgtagaacgcgctgcactaaggtatgtgtatcaccggttgacagagacagctgtactttcgggtagcggctgcaatactccgtgaaaaattgagggagatggacggctgccgccgtttcaagagaaccgattcgaagcgggccgttcggatcgcctgcctcttgcgctgttttttgcgcctcatgcagcaattgaaggattctgtctgcgtcttttaataagttttcacctgctggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatgtaagggcaccttcttgctatgatttttattgatagccggctatcaattttcatttatttactgcagctgatacagcctgtaaaatttttctcatcaatcataaaggagagaagaatcatgaatgcccttatcatacacgaaaatggctttaatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggtgcgggaatcgtaaccaaaataggacacggcgtccggtctcatttactgaatgcagaagtcatcatcaacccggtgctgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggctattgacagctacggtgactggaatgaggcgctgaatggcgaaaaagcagatatcatacttgacggtgtaggccccgctttatatcaacactatcttgacattattaaaccgaatggccggatcgtaacattcggcgccagttcaggcgatcagctcggatttcctattcgctcgctgttttttccgcagattcatattctcggtacatcaatgggaagcaatgaggaattcgcggatatgctggaattgataaaccgctgcgagctccgtcccattatcgaccgcatgtaccctctcagtgaagcagctcccgcttttaacagaatgcgggaaggacggcagttcggcaatatcggctttcgtatagatgtctaaaaaaaggaacggacccgtccgttcccttatttgtttttaagcgttttcgcttgaaattcaatatgtttttcttcatcgattaaaatctgccagcaaatcgactgcagacacacagagcccgtcatgttttttaaggcgtcattttaaacggcagcgatgacttccgccgtcagcagcaccctgatcgattgcgcaaggcttgcaaatcgtatcagtctgcggaaaaaaacaatctctccgctctgtaaaacaaaattccatatttatcctccatttccacattacctttatatgaccaatacaagaagaaggaggttccatttcaatacgaaaaaccggctgatcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgactccgaactgtttcaataatggctgttctgtcccttcaaaaccgatggcgatgaacaccagctgagcaggccagactttttctgtaccgggcagttcatgaaattcatactttccgaattcgtttctgactttttccatttgaatggtgtggatctcttgtaagcggccctgcttatcggccaccatttttgtcgtttgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttgacgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatatcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcgtagaccgttacggaatgaccggcttgattcagctgatcagcgcttgccagacctgccgggcctgaaccgacgacagcgacttttttacctgtgcgtttcgcgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaaacgagtgagagggtcccgctcagccggtttttctcgtttttcttccatgaatccagttggtttccccatgttcctctcccctttcttactgtactaccgcttgtttttgatctttggcaggcgtttgctgaacctttgtattggcttcaaaagcatacataattgcgtcttcttctgataaacccgccgctttttgttcttcgatgctgaggagcatttgtttatagtttttcggaatgactttgataaaggtttctgcggctttttcccaattgtccaggagatttgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgaggacgacaacccggccgcctgtcatgtattcacagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcacaattgaaggcatcaggcgctttcacgatgatttttccgcctgaaagccctttgcctacgtagtcatttgaatccccgttcaaatgaagcgtcatccctttagggacaaatgctccgaaactctgtccggctgatccggtaaaatgaagtctgatcgtatcatccggcaggccttccgctccgtagcgtttagaaatttcacttcccgtcacggttccggctacgcgatttgtattattgatcttgatttcagcttccgcttcctgaccagcttcaattgcagcctgcaccgccggaagaataaccgtcatatcaagcgactcgtcgattttatggttttgcgccgtacggaaagtgcgtatgccttcaggctggtacagcagtgtggataaatcaagctggcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggatcgcccatgaattttttgcggagctccggattttgcgtcgcgacacctacaggacatgtatctaaatggcaggcgcgcatcatgacgcagccgagaacaacaagcggcgctgtagcaaagccgaattcctccgcaccgagcaaggcggccatcacgacatctcggcctgtcatcagcttaccgtccgtttccaataccacgcgatcccgtaaaccgttcagcatcagcgtttggtgagcttctgcaagaccaagctcccacggaagaccggtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcatttttcaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgctccttgcgccattttgatctgcaattcatccgcattgacgagataatggctctttacgccgaaacggccggaggcgatctgtttaatcgcacttcttctgtcgtcgccattttcatccggaacgaaacgtttcgggtcctcgccgccttctccgctgttgctttttccgccaagcctgttcatcgctatcgctaaagcctcatgggcttccttgcttaatgaaccgaatgacatcgctcctgttttaaaacgtttcacgatggacgcagctgattcaacttcttctaattttaaaggcttgcggtcttctttgaaggcgaacagattgcgtaaaaatccgattcgttcttcatccgctgcatgagaatactgcttaaacaggctgtaatcattttttcggcaggcccattgcagcgtatggatggttttcgggttgaaagcgtggtgctctcccccgttccgccattggaattcacttccaggatcaagagtttggctgtaatcatccttgtacgccgcttgatggcgctgtttcgcttcttgcgcaatcgtctcgatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgcaggccttgacggatcaaatgctgatgcagcgcactgacggccaaaagcggcggaatcggcgtcaattccctactcattgccctgtcagataaaattaacagagatacgccttccttgatcgctttttccgcttgctgaaacaaatccttcaggcctttttccaggtcatcggaaaacagcgtgcggatgttctggctcttaatatcagggtgcacaagtgttttcagcgcataaaactgttcgtttgataatacaggagtatacaattttatgcggcgtgcatttctttcactcggatgcagcagatcaccttcagccccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatatttctggatatcttcatacgtatagccaaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttctcctgctccacttcaataacgccgacctcagatgagaaaataatatggtcatcttttgtcacatagtaacgtgccggacgcaggccgttacggtcaaggatggcgccgatttgttttccgtccgtaaacgaaatggcggtcggcccgtcccacggctccattaaagagctgtgatattcataaaaagcccgttttgctttagacatgtgagtgttttccgtccatggttccggaatcagcatcattgccgtatgtgccggtttccgccccgccatcacgaaaaattcaaacgcattatcaagaatggatgagtcactgccctcagcatttaaaatcggcagcactttgtgaagatcgtctccgaagctttctgaaacgaactgctgctccctcgctctcatccaattgatgttgccccggagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaggcttgcgaagtaaaaatcaagctgttcttgaacgccccaattttccgcctgcttccggatgacatacagtttgcgttcaaaagcaaggctgtctttcaaatcgtttgcggctccgataaatacttgacgcacatacgggcaagtgctttgtgccactgttccgatttttccgacatttacagggacggttctccagccgagaacaatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaacggcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttccgacggaattccccgacataacaggcaatatcttattcacggaaaagatttacgcgcttgttccgctgcatcatccgcttgccaaacagaaaaatattcatttaattgatctgcgcggggaccaattcgttttatttcctgaagggtttattctccgaaacatggcgattgacgcttgcagacaggccggctttgcgccgcttgtatcgacggaaggcgaggatttagatgccattaaaggattagtctccgcggggatgggagttactttattgcctgaaagcacctttgcagaaaccacaccccggttcacggtcaaaattccgattgaatttcctcaagtgaagcgcaccgtaggcattattaaaccaaaaggaagagaactggctccgtctgcaaatgatttctatcattttgtcattcaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgaggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagcgccatatttccgttcgcgacatcgcggctgcttttcttttccatcacaatttcgccttcggggccggaattaaatgcaagccattgttctttgtggtttaacggcagggttccttccgcttcaaaataagttccttcagccgcctcatctaccgcttgaagcagaatgtccggaatgttagcctgcccgagaaagcctttaataccggaggccatcacaattttaaaagcatccagtttcgaacgcattccgccggttcccatttcactcccggcatctcccgcgcttgcttctatttccggagtgatgtcacttacatgtctgattcttttcgctttcgggttgctgcgcggattatcatcatataaaccgtcaatgtctgataaaattacaagcatgtcggcatcaattaaacctgccaccttcgctgcgagtgtatcgttatctccgaatttcagccggttgactgtgaccgtgtcattttcattaataatcggaataatgccccgttccaaaaggacgttcatcgtattgcgcacattatggtagcggtattcatcggaaaagtcgcttcttgtaattaatatttgtgatgcgacataaccgtgcgctaaaaacagctttgagtaagcctccattaataatccctgcccgatggaagcagaagcctgtttttcagggaggccttccggtttctgaataaatccgagcttccgataacctgccgccactgcgccggaagatattaaaatcacttcatagccgctgtccttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcgtgtttaatggctttggcaatggcttctccgccgccttctgacctgagcgcatcgaggccggcttccgtcgtgccgtttggagaggtgatgttttcccgaagcacatccggtttttcacccgtttccatcagcatttttgcagcgcccaataacgtttgcgccccgattttgcgggacagccgtttgtctaagccggcttcttcacctgctttttcaataaactccattaaataatagaagtacgccggtccgctgcctgcgatgccggtgaaaatgtccatctgatcttccttgatcacgtacacttccccgaggcattccaaaagagataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttctgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttggaggttttattgatatgtattgttccgagcctgttattatgtataatgaatcacagaacaaaccttttgagcccgggaggccgggagcgttccgcccggatttaaaaattatctgaaatggctttttctatcagctttttgcagcggtcaagctctgtcttcagctgttttttgtaaagctttgcagcttcatagtctttaaattgatagagaacgacttcctggagtttggctccctcttttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgtttcactaaaaaaccggttgaacttcttttttcttctttcaatatgtgcccacccttccttctaacaaattattccatgtactaaatattctctttatatcccgttttcccttttattgttcggacagtttggtttgtattgatttgttttttggatgcggggaaaaataaccttagtgaacatttggtacatagttcatttagtttaattatagctgatatcggtttctttttcactcttttttctgcaaaaacggatctttatgcctatttaatccggttgcgaaaacaaaaaaagacccgtcacgaagacaggtccccttttgtttaaggattagttgaccacaaaccggcagttttgatgaaaatgcgcggatgtaatttcaattgagcaaccatatattctgcaagatcctcaggctgcatgacttttttcggattgccgtctgtcagatttaattcaatagacatgtcgcttgcaaccgtgctcggagtcattgcgctgacacggatattgtgttttctgacttcctgcatgagagattcggtcaaaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttgaggcgtaagatccaaaaatccgccgaatttgctgattccggcattgttaatcaggatgtcaacctcaccgagttcttctttaatagaggagacggcttgttcaacctctttttggttttttacatcggcagcagcgaatgatgcctttacaccaagggctttcacttcttccgcaaccttttcgacatttgcttctgtacggccgattaaaccgatattgactccttctttggctaaagcgatagcggcggcgcggccgattcctctgcccgcacccgtgataagagccgttttgttttgtaagctttccatgtctttcaccctttctgaatgtccttatgtacgatttcacattataagcagaaaaaaaacaattagcaaataaaatgattcagcacgatcggtaaagggtatcaactgaaaaaaaggagtgaaaagcagatgatcatcattttgtatatcagtgctgccgttgcggctgccgcattaatttatgcagccgtatccgccgtgcattttaaaagaaacacagcgcctgatataaagaagattaacgccgcgacagcgtccatgcagacgtctgttgaagaaatcaaaacagaaacccgtttgttatcacaaaagcagaaagaactgcaggaagactttcttactaaaaaaacagccgtgcaaacgacggcagccgaagttaaaggaacgcctcacgtcctgaaaatgctctggaacgccggtaaaagcggtttatgagcctgcatgtcatccgacgtttttgatgacactaagagaaactggcggattcaaggaggcataacatgatctgcgatcgtgagcggcttgcgcattttttgcagcagcttaaagcattatcatcttcgggaggatttacaaaatcggatttgctgactccggagttccatttagccaaggacggagatctggatatgtattattcgcctcataatgagtatatcaacccacatgctgcggttgtcatctccggaattacacccggtttttttcagatgcagcgggcgtacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttttttgattcaaaacgggagctgcttcatacgacatccgttattaaacaccctgttttttataaacagaaaaactatacgggacaccggccggccatcagcagatcagctcttctcagccgttacgcgctgacatgttttccggatgaaatagaaatgatgaaaaaagacattctgcttatccctctcggaaaagcagcagaatcagcctgccgcacgctgaagaagaacggcagaatgggccatgcggtcattctggaaggcttcccgcatccgtccggagcaaacggacatcgtttcaaacaatttcacgaaaacaaacaatcgttacgtgaacaaattcagcggtttgccgggtttcttcatcagccgtaaaaaaacgccccgaattttcggggcgctgctgttaagaagcgtattcaggcaatgctttattgtgttttgccgttttctcttcaggtattttgatttgatttgtcaagatcgcacttacgaaatagagcgctgcgaaaatccatacaacgccttgtgcgccgacaagcccgatgaacgcccaggcaagcgcggggccgacaaatgccgacaggcccgcagccagatttaacacagacatagcagcacctttattgctgccggccgccgtcggcacgatagccccgatcggaacgaacccggcgaggagccctccccatataaaaccgacaatgctgacgaacagcaaattcccatgtgatacaacaggagcataatataataaaagagtaaaaatgccgcagcccactcctccgaaccacatgacagtctttttccagccgaaggcatcgccgactgcgccgaagattaagttaaagacgatatttccgagaaaaatcgttccccaaatttgcagccatacatttgtagaaatgccgtgctgcgccatatgcatcgggaggaataccggaaatccatatgttccgatgctgttaatgatccgaatgatccccccagagagcacgcgcggattttcagcaaggatggtgattcccttcattaattcctgcgccttttcccgcttatctgcctttttcttttcaaagcggtccctatttaaaatcaaagcaaaaaacgcgccgaggcatacccagaaaattgaactccacagcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaaagaataggcaaacagcggataacccagccctttaataaaatacgtgacatacatcaccggcaaattaagattctcaaatccgtatgcgataaacgcggctgtgccgatgacgtaaaacaacagccccataaacatcgtccgctttgcgccgaaggcttcgaggcagacccctgaaaaccacgacgccacagcaagagaaataccgtaaaccgtaaacagggatgctgattgctgtaccgtcaagccgttttcaactaaaaacgggctgagccagccttgttcaaggccgtcccccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgggtatgtttccattcttcatataggaagagatccgtctgatccgcttccggctcaattacctttgtgcaggtcgaaagctctgctttcacaccgagagcttcattgcaaatcatcaccgctcccattgcggatgcctggctgaacccctctctcttatagattttcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcagctttgacaaaatgggctctgcttaagttttgggacagcggagcgtcaaaaataaatccgccttttgccagtgcgtttttctcaggagataaataggagcctaacgcagatatacaggcatgatcatgtttcggcagacttgcgatttcccgttccatgacgctgtaggattcattcggataaaaaatggattttaatttttgataattgagtcctgttacacccggattcgtttcaagaagccattcaccttcttctgtatggcaattcagccatgcattctctaaactttcggttccggtctccgctgttatctttgtaatcggcgtcgtcgtgccggatacgatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatggcagaaggcacaccgaagatgttgcataatttctctgaccacgcctttttccttacgtcaaacagcagtgtttcagcagcctgtgacggttcatagcttaaaattccgctcagctcaaatgtcacccagtcactgatgcttgtgatgcacttcacttctttccataaagacggctgtctggcttttaatccgacaagtttcatggcggaaaataaagcgctcggaagacgtccggtttgctgatgcacttcttctgcctcaattccgccttcccattcacgccctctgttatcaatgttgggcagaccgagaaatgcctttttatctttattgatcaaaacgattccctgcctctggcttgttgaggtgattccgattaatgtaatatgagggctcttggcaatagcctttcttgccatagcgctgatttgcgtccataacccttccggtgagaaatatcgtccgtccggataaaacggatccgtctcatattcaatgtcttccctttcaagcgcggtcacttcgccgccggcagtcacgaccgcgactcgcgcattcccagtcccgatgtcaaatacaaggtagcctttttgttcagccattacagccgcctccttccgtttcaagttctcttttgttataaagttcacgtattgaacaggtttgatcttgtttccatttgaaaagcgcttcatttaaaatcttcacatgatgatcttccacttcaaatgttgcgcccgctaaatggggagtcgcgaacacattcggcaaagagatcaattcataatcagaagattcaggcggttcgtgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataaggccgatggtttcttctgtgcgcggcaagtgaacggaaacaatatcactttcagaaaatacccgttcaatcgtcgttttttcatactcccggttttcatgacggacaaatggatcatagtaaagcaccttgcagtcaaaagcggccaatagcctggcgattctctgtccgacagctccgaaaccgataaggccgactgttttccccgtcagctcatttcctctgaatttgacgtaagcctgcaaataatcaccattccactttccgtccttcagccactgatgggaagaatacgtatgacgcaaaaatgaaatcacatttccgataaacatttcagcaacggcctgggcattgcgggccggtgtaaagaaaacggggatttttcttttagtcgccgccgcaatatccacattagacggcattcctctgcagacaccgataaaagcggaatccggcaatatgtcaataacacgctgagacacctcatcaagttcggttataagccccgacgcgtttgtctcttgaatcatccggatcaattcatcttcccgataggcccggccgtgcttcttccacggccggtgcacagtccggccgaacagctcagccagctccttcagcccctcgtcgtgatatggcgcggtaattaaaaccgtcatggtgcaaaacatccttttcacataaattttttcataaaaaaatctctttcctcaaagaaggaaagagattcatataccgtctttatacgcttgaagcgcacaaatatgtatagaccattctttcctatctttcaagcatacgcttgctggaattggcacaataaatgttgccgaggattcatagggccagtccctccacctctctggatagaaaataaaatgatgaaattgtcaggctgtttaaaagaataaactcatcatagaaaagtctttccgtaatgtcaacacttttttctgaattgacgttcgattttgaaatgttataatgcttacaatataaacaaagaggagaaatgggctatgaattctgctgcaacacagccgaacggggtctttaagtcggtgtgctcactagactgtcccgatcaatgcggcttgcttgtgacaaaaaaagacggaaaaatcgttaacattcagggagaccccgatcacccggtcacatcagggaatatttgcaacaaagtcagacacatggctgagcgtatttatgatgagaagcgcgtaaccgttccgttaaaaaggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatctgcagcaaagccggttctgaaggctataactatacaatgggagaaggagcgggtactgatccggaggagaccatacatgctaagctctttattttttggggaatcaatgccgtcagcacgaatatgcaccaagtcatgattgctcaaaaagcccggaaaaaaggggctaagattgtcgttattgatgtacataagaaccaaaccggccggcttgctgattggtttattcccattcgtcccggcacagatgccgcactcgccctcggtatcatgcatgtcttattcgctgagaaccttcacgatgaagcatttctcacagaatacaccgaaggcagtgacgaattaaaagcgcatgtcaaacactatgatccggaaacggtttctgctattacaggcgttaaagccgacgatatcagacgccttgcgagaatgtacggggaaacctccccttcccttatcaggatcggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatctgtttttaacggaaaccgccaaatatgcggatatcgtgctccctgcttcatccgcttttgaaaacacggatttttacacgtcttactggcatcattttattcagctgcaaaaaccagtgatcgaaccctacggagacagcaaatcgaatacggaagtgttccgtctgcttgccggagcaatgggatttaccgagcaggagcttcaggattctgatgaagaattaatcagacaggcgctggactttcccgacaatccgtatatcgaggatattgattacgaagcgctctcaagccattccttcatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagatgctgtacaccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatcctccggccggcttcaccgtataaaaatgataacgtttattggaggtttggatatattaccggcattggaatcgctttagccggatatttcatcggagacggattgaaaactttaactcacctgatcctcatgaatatctgacattccgcatatcacgagaaacggaaagcggtatgtgcagaaaccggcattaagagaatggctgacttccatgctggaaaaagaataacagctgctatgaaaagcgggaagagtttttctcttcccgttcattaagatttgccccactgcctctcttcaaccccaaacatacgacagatatcgttcttacgtaacgaaacatccccttcttttgatttcaaataaaaccctttcttatataaccgtatgacttcctcatatgtaagctcatgacgaaggaacgccattaaacgcccatctttttcatcttgtttattgaaccattcataccgttctgaccagttcactttctgcatgtcaaacaccttcccactttggattaatgcccttttcgcatttattatacttatttccccttttgtaaacactccgactgtctgtggcatttttgaaaacagccgtacccgccctattagtcaccatgttgacttatttcccttcgtgatgtatattgtaattgtcaacatggtgacaatttagatgggagataacttatggatattaaattactaatgaaggaactgcattttatgcaacaaagttacgcatcattattttcggttgtcaataaggtgcagactcggggggacgaatacttagaaatgttgacttcccgacagcacatgactcttattgctattgcccatttaccgacggaagataccacacttatgaatatcgctaaaaagctgggcacaacaaaacaaaccgctaacaaattaatttcaagtctctcgaaaaaaggatatgttcacactgtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggacggttttgaagaaaaagcacatttgaaagttgaagaccaggcacaatccatctcagatgactatgaagaaaaaatcatggctgaattttcaaaacggcgatatgggagtgcaaacgatgaataatatgctttatcgaaaagtaaaagaaactgaggataagatgaaggaaaaatgctatgagctgaaagataaaattgatcaatttatttctcatgctaaatataaacttcattgcaatcgtaaactggaccgagccggcaattatatatcaattgccattggactctttatcctaactgcctcatggctgaccgcaacacaatggctgctttggataggcgcggcgagtattttgagtaatgcctgtttgctcattataaagcctgttaaaaattgaaaatctgaaaaaagctctctaaaagagagctttcttttattaatcgtcttagtcttcatcttcttcccgattttctttcatctcatgaagtctttcataaaagaactttataaaatggaattaagttctttatagccaccgaattcactccaaataacaactggacattctcctttccgttactttaagtcatttattcacaaagtaatcttttttacaggtcatttagtggcagccccaggaaaatgcgaatttacaacgttaatcaaattcaaacataaaaaagtcgaattccctgtcctttaaggaaaacgacttttttatacggcttcttcaagtaaatccccattaaccttttttggggaagatttgtaacctctgcgcagtgaaattatacctgtgctagcccgccatctacgaacaattcaatacccgtcaagtaactgctttcgtctgaagcaaggaaagatacagcgttagctacttcttcaggtgtcccaacttttccagctggaacagtatttccggcattttccatcgctccttcaagtgcatcaccaaaaagctcatcgtatgcaggtgtaagaatcactcctggacttaccacatttacacggatttcagtaccttttaggtcaagaatccagttgcgaaccagtgctcttaatgctgctttagatgctccatatacactaaatgctgggttgccaattgatccagcagtagagcccgttacaataatagaacctactttgtccgggaatagtgatagcgctttttgaacagtaaaaatggttcctttcacgttaatgccgaacgttctatcaacctgctcttcagtaatttcacctaatggaaggaagctgccgatgcctgcattagcaaaaaggatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgtagcaagaccaatcccacttgttccacccgttacaagcgctactttaccttcaaattcacccatacttaacactcctttagaattaatattattttatgtctagtacctttaagtacttgaagaacaacttacaagtaatagtatccttcagtaagcacattatcggaagtacccacttttttgtgatatagtaactaaaaagtaataaatgtggaatggagagctttagacatgaaaaaaaaatttagttgtgggtttgaagtgacaaaggaagtgattggcggaaaatggaaaggccttgtattatactttttaatgaatggaccaaagagaacgagtgaattaaaccgcattatcccaaatattactcagaaaatgctgattcaaacacttagagagcttgaagccagtggacttgtgagcagaaagatgtataaccaagtaccgccgaaggttgaatattcatccactgaacttggagaatctcttaaacctatcttgcaggagctctgtcaatggggaggccattatgcggagcaaaagtatgcagaaggtgaatatgaaattgtacagccagaacaactaagttaggattgatgcagctgctgaagtaaatgctaaacaacttcaataccatcacctaacagatgaagaacagtcagaaataaatgagatattcaattttaaaagtgaagttataataagaagtgtcatggactatattcaggagaactttgatgaaattcaaaaaagagctgtttcaaatgttaaagagaaggttcagaaacttagccaaaagataaatgaagacatcagtaataacatttaatgcctatatggtctcttcgcatgcattttttacacaaaaagacccggattttaattccaggtcacacttcggtcacaacttgctcaaattccctcttgcatttgtcgaactgctttattcaagatcataaaatttcaaacgaaccttacacgaaggaatcggggatcggcaaaacaaagccagatataacatatattaaaaaatctcttgcatttccacaccggccatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgactgctctggcgtaagcaggacaacatctcctttttccgggatgccgccaagaacgagaacttctgacttaaatccggcgatccgccgcggcggaaagttgacaatagcggtaacctgcctgcccgtcagatcacccggttcgtaccgttttgtaatctgggcgcttgattgtttcatgccgatctcttcgccgaaatctattgtcatcttaatggccggcacctttgcttccgggaatacttccgcttttacgaccgttcctattctgagatcgagcttgataaaatcttcgatgactgccatatcaaaaactccttttttacaatcatgataccaaaaaaagacgcagtttatttaactgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccccgtctgctttttaaaccagtcggaataatacgccgggtggtaatgttccattgcggcaagctctttaattgaaaaagtctttgagagatttcggcggatatacgcaattgaatcattcgtacggttttcttgtatcttttcagcaatatattctgcaagcagactcaatgaatgagccgactgctgcttagtctcttctgtcagcagaaaccgaatcgatgtccaaaaagaatcaagcttattcagaacgccgggatcaaatgaacctttgaaaaaatatgccggtatgtcgagaacgagacattcgtttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgtgaataggtgcgccgctcacaaatgatatgttgtaatgaatccatttgtccctccttttactgatgcgtttttttatttagtttacataataatattattgttacctaccctgtaaacctcttaggaaagcaacaactgcaaacttccggctttccttaattgattcggttaattcaaatgcactctgttttctcaacacggcaaagccgtgaagaaggctcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcaaataacatagttaaaccggagacagccagctctgttttaattccttgaaggccattgacaaaattgtaaagggaaggcggttttacgtttaaggactttgcaacggccgcaagcgtcacttcgttcagccctttttcgtcagcgatgcctgctgcggctctcaatatcatgtcaaggctcattccgactctcggtgacattatgatcggcctcccggcaggcttcgttcagcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatctgctcgccgcctttcagcaggcgatcaggttcggtctgaacatttttcggcactcccccctttatcggcgtttgtgcttcatgctcaaataatgaagtgtcacctttcagcaagaaagaatcccgctcagaaatacagacggaggcatccggaaattccgcagctaatgagtcaagcgaaccgatgtgatccccgtgcgcgtgggtgagtaatatgtcattcagcggcttcccaagctgccgcaatgcttgtttgattcctttatgactgttaggcagtccggcgtcaatcagggttactcctacttcttcttcgaccaaataacaattcaccgggaaaagcgctggaaaaaaagtcagctgccaaacccttccgtattgtaagattctcatcaacatccccctaaaactaatatcgttagttttattataactaataccgttagtttatcaagagttttctgtttaaatcctgaaaaaggcgcgggcgcttctcttatgcaaaaaaaagaaacgcgcatactgtgataaaagatgctttcagcctgcgaataaatcagactactaaaaccagccggataagcatacactactcaacggagggggagtttcacaccatgcatatcacacttcaaagcatctgccctgtcttaatgattgccttttttctgtataaaaaggtgaaacggtccgtcggctttcagcctttgaaaccccgctggctttatacaagaatgattttgttttcattgctggccgcagctctggcgtttttcagcatcacacacccggctttatacggccatcttatattcggcactttttgcggctggcttctggtcctgtttgccaaacggaatatttcttttgaagaacgccgcggaaaaatgtattttcgcactcacctgtggattgaacttattctattaacatttttcctatcgagatttgtttatcgcgttattgaaatttaccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggagaataatagatggatgttccttctctgcgtgatttgacgaggcgcagatttttaagaaaacgcagctgatgagaaacggtagactgcagcaaattcagcttttctgcgatatcatttaccgcgtgttcaccctgtgacagcaaatggagaattctgattctggtcggatcagacagcgccttaaaagtctgggcaaccaaaaataaagtttcctcatctaaatcgacagcggggtcattcgtgtttccggattcgtgaaattcagtcatatacctcacccttcttttctcaagtagcccaattataccaaatgtcaattgatgcagatacatcctgcgcctgacaaaagaaccgttattttaaatttatgtttcaaatacgggtttccgcttggtttcgcgcattcatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttccatcaatagaaaaaagccgcgcagagcacggctttttttaataatacggtgagatcattaagtatacaatgacacccgtcagactgacatacagccagagcggcatcgtccatctcgcgatttttttgtggcgctccacctgcatgctgaatcctctgatcagcgtaaacagcgcaagcggcacgataacggcggaaagacagatgtgcgtaatcaaaataaagaaataaatcccccgaatgatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatagcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcactttatgttcgttttcattcaacagattttttggaatgatccgatctatcggtttattcatatgctgatcgagaatatcggctgtttctttgtcccctgcgattacgagacgctcccattggtgtgaagcggccttttgatcaaggtttgaagccaatcgtttatacagcctgttttggttttcttcgacatggactttggcggcgtcttcgtccattgatgcggagcttccgcttacatcctgcggtttccacgattcattgatgacgtcgtattgataatgctccaccccttcaatttttccgagtacggtttctatgatcttcacttcattctgctgggtgagaataaaagccgtgcttggaaattgttcacggagaagttctaattgatcaaggacagccgtttcttcccaataaaatcgtgtttcgacaggcacctgcaattcaatcgtctcccagacaccgccttcccccgatgcaaaaaatacgaggcttcgcggcatctctttaccaagcccatcgatatattgatagacacgttccatgatgcggacgagagatttttcttcttccggatcacttacagacagatactcttttaatctccgaaaaccggttttcaaggtgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccccaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgatgattggatcattgtttcctcgattgatgatggccaaacatgtaagattatgctgactgattgtgaatcagcctaccggggaagaggctgtttttcactgatcgcttcttattatgacaatgccattcatatcggggatattaaaggccccccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaagcatcaatttgatgtctggattgacaatgatacgcaatcaggcggcattaaatgggtcgacctgtaaaaaatgatagataaaccctcgttaatatggtgtaatagattaaaccatttaaggagggttttttttgtatccggaaaaattgaaaaaaggcgacggcatccgtattgtgtctccggccacaagcatgtccgctatgtcagatgaaaatataaatgccgcgaagacaaaattggaggagctgggcttttgtgtctctttttcagagaatgcgaaggaaataaatgaatttcattcatcatcgattgaatcgcgtgtacgggatctgcacgaagctttcgctgatcctgacatcaaagcgattttgacgacactcggcggcttccaatcaaatcagctgctccgctaccttgattatgaaaacatcaagcggcatccgaaaatcctttgcggctattcagatattaccgctctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcagcccggatatgcggaaggaacactgatcggaggaaatctatgcacgctgaatcttctgcagggcaccgaatactttccggagatggaacaagtgattctgtttatagaagatgatcatatgtcggacattcatatgtttgaccgggatttgcagtcactcatccatcttcccgctttttcagccgtgaagggaattgtcatcggacgtttccagcatgcttcaaatgtgtctgaggaggctctgcgtgccgtcatccgtacaaaagaagaactgtcatccatgcctgttatcgcaaatgctgatttcggccatacctcccctttgatgacattcccgatcggaggagcatgcaggatagaagccggctcagaaggcggacggatatggatcgatcggcattaatacataaagacgggaaaaccgccccgtctttttattttgacgccttatgccgcggcgtgcgaggagcgatcataattcgtccgccagccgctgccctcacccatacggaagctccttcataaaaacggctgatctcttcattatatacggcgtgtgtcagttcacgtttatcatgcgttccgtcttggttttttacgtttaaaataagtacaagctcgtgcctgccattcttcatcacgccagtacgtctcaccttttcaataacggctggccttcctctccctctgtcaagcgcctgaaacagcctgacagcaggcatagacagtccgataacgagcacaatggcgaaagcggtgcatatacctgcttgaaacaccggtgattctgtgaaggtattccataaacatatacattccggctccatcagattcatcccttcaattcttttttcacatccattccttattatattagagaaacgctttttctttttccgcatataacgattatatacagtcaaaaaagggaagaaaaaaagaacacaaagcatttcgccttgtgttcttcatctctatatgaaactagtctaatactttaacatttactgttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcagctgctttttaggctcttgttggtttgtatttgattgaacaggctgctgttttgcttcgacagccttcgcttcttgtttaggttgttgttgttcttgaacaggttcttgtttaggctgctcgtttttgacagcttcttgtttcggctgttctgtctcagcagctggtttttgttcagtttgcggctggctggcttcttgagccggctgtgcagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaatgattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaagcttctgatttttccggcgcccatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctggtctgagaacacgacaaatggaggcacaccctgttcagctgcaatctctttgcggagacgccggagaagctcaaataattcatcattttcggtaacggcggcggcctgtaaggcttcttttctcgcgactgcgctttttccaagcagaacgtccctgcctttttgggtgaccataagcgtgggaaatgtgccgtccgccattctgatatattcatctgaaataagaaattcgataaaatcactgatttccgctgcggattgatgcttcataatgccgtaagtggacaggctgctgaagccgttttccagcacttttttattttttgacccgctaagcacctgcgccaccatcgtttttccgaagcgctcattcattctgatgatgcaagacaataccatctgcgcttcttttgtgacgtcatgggcggtccttgtatcagtgcaattgccgcacgcttcgcaagcttccgcctcattctcgccgaaatacttcagaataaaccgctgcaggcaatcttccgtatgacagtaatccaccatctgtctcagctttttgagatcctgcttttgtttttcttctccggcggccgattggtctattaaaaaacgctgcaccataatatcctgcggcgaaaataagagcacacactcgctgttaagaccatcgcgcccggcccgtccggcttcttggtaatagctctccatatctttcggaatctgcgcgtgtaaaacaaacctgatgttgctcttatcgattcccattccgaaagcggacgtagctaccatcacttgtatctgatcattaagaaaccgctcctgctggtcttttctgtcgtcatccgccaatctgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttgcagatgtcatcatgaacctcaggcgtagccgtcgccgttaatgcgatgatgacgggcggttcttttaattcattaaaaaggatttcgatattccggtaactcggcctgaaatcatgtccccattgcgatatacagtgagcttcgtcaatggcgacaagaggaaccgtaatattctgcaggatatgaatgaattctgaagaagtcaaacgctccggtgtgatgtaaaagagccggtaagccccttgtttcaaaccggtcaggcgctcatgaatgtcacggcttgtctgggtgctgttaatataagctgccgcgatacccgcttcttcaagcgcgtcgacttgatctttcattaaggaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcatactgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtaaaaaatgctttattctacataaaaattgttttttcgacaaaacatcaatatatcaatataagatcagatcgaaagctgccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccgagaacggttttcatgaagtttaatgacatttcaagagatgccatcggtccttcagaatatacgccgccgcgtgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttgacaaattgatttaagtaaatgtcagcagttgacgcttgttttttctcttcgtctgtcatttcaattccttttgaagctttgaatgttccgttaatcatatctcttccgaggtaaggaaggttttctttatgaagatcaagttcgatcacttcatcattcggattgttttctttataagcagccagaaacgcttcgtataattttacggacacgccttcttcagccgtacggtcgcttgattttacaaataatacttgagacattctaaattcctcccggtaatcttttaatatttacttacaaatagtatgttactttcttttttatataaagtcaatgattttatttcgattctgagattttttatggaataaaaaaacaggtacatatgaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggtacggcttcaagtctttcataaggaatttcttttcccgttttctcgcaaatcccgtatgttcctttatccattcgttcaagcgcggcgttcacctcatctaaaagattctgatcgacaccgtccagcgtctgattcgtgaccctgtccaaataaatgcttccgtgatcagctaagtgattatctactccgttcgacagttctcctgtgtcttcgctcattgaataattttcttttgattctccctgaagactttcctttaaatcgattaatttatgataaaggctgtcctgctgttcttttgataatgacatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaatcttgtccactttgacgtgctcaatatggacatatgttttttccccttcaaccgtttgcggctcaaaatgacacttatcctgaagctcataaagctgttgttccactttcttaagccggtctaattcttcttcacacacttttttgaacatctctttcattatttttttcaaagaaaatcacttctttccccgtcactcttggaaagttctatgcgtcccgtattgcgaatatataaacatgatatacaaaaaggaggcgaatcatgatgttttttccgtccgttatcaactttgagtatataaaaatgaacggaatcagcggcggagcggcttttaacaccggctcttccgttatggtgagaaacacagcagccaataaaagaaatgaagggtacggtgaacaaaacggtgattgcaccgttgtcgccatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggagtgcggaagatcgagttttttttcaaaatcgccgtattttccggtcttctgtttaaaatcctgttcattgaaaaaggattttctcgtgccttttacgacaatatattctccataggacaaaagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacgatcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatattcccatcagttctatcgctgatccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacattcccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgctgttatgaagtaatacggttcagcggaagaaaaggtttcaagaaaacggtatttttttcgaaaagtcagttttttattttcgccataaaaaaccgcggcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaataaattcattcagctttaaacttcttcaaaatactctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttaccgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagtcagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacgattccggtcgccggctcatattttaattacacccgccatgagcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgaccaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgcctgatgccaatttgaagaaagccattcccggcgctttaaacggggtcatgtttaatcagggacaggtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgagcgggcgaaccgctcggaatacggtcttgcagccggactttggactgaaaatgtgaaaaacgctcattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattaaatcaaacaagaaactgctgcctgtcagcagtttctttcttttgtcatgccgccttttacatatgaatatatatgcttctgaaggagttgagcgagtgtgagcacaattcatgaaaacgtcagaagccgccaaaagaaaatcatctccctattaagagaaacgcaaaatgcggacggctcatggtcattttgttttgaaggtccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggccgaacgctttatcatctcaaatggcggcttgcgcaacgtacacttcatgacaaagtggatgcttgcggcaaacggcctttacccatggcccgcgctgcatctgccattatctttcttagtcattcccccatccttcccgctgcatttttaccagttcagtacatacgctcgtattcatttcgtaccgatggccgtgacgcttaacaaaagattttcgctgaaaaatcccaatgttccgtctctcgcgcatttagatcggcatatgactaaaaatccgtttacatggcttcgttccgatcatgatgagaacagagacctctcttctcttttcgcccactggaagcggcttttgcagattcctgccgcttttcaccagctcagtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcagcgatataccgtacctggaaaattcaacgtcggccgtttgggatacggcgcttctcagctatgcgcttatgaaaagcggcatctcggataacgatcaaatgataaccggcgccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccattccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttctcctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcttttcttattgaaaaccggcattacgaaggatacgctttcagctatccgaccggaatcggcctgccgaaacagttttacatcaggtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcggcacaaatcgaccggatttttcacacccttcaggatgatggattaacggaggcggaatggtacgaacaggcatcagcactttaccgggacattaccgaaccggatgagccggatgagcgcagagcctatgtgccgatcggcaagcatgtcctccctaaactgccatacagttattccgcactggaaccgtatatttcaagagagattatgaaactccaccatactaaacaccatcagagctatgttgacggtctgaataaagcagaactggagctcaaaaaagcgagacaaacgaaacagtacgacttagtggcgcattgggagcggcaattggcgtttcacggtgccggccattatttgcacagtattttttggttttccatgaatccaaacggaaaaagacggccgacgggtgcgctctttcaaatgattgatgtgtcattcggaagctattccgcttttaaagagcaattttctcaagcagcaaaaaaagtcgaaggagtcggctgggctatccttgtctgggcgccgcgctccgggcggctggagattttagccgctgagaagcatcagctctacagccaatgggacgtcattcctttgcttccgctggatgtatgggaacacgcctattatttacaatataaaaacgaccgcgcggcttacgtggatcaatggtggaatgtcgttgattggcgggaggcggagaaacggttcgagcaagcgcaccgcgtgatgtggccgctttattaaaaaaggcccccgtcttgaacgggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcggaattttcagcggtacgaacacggcaattaaaagcgcgcccaacggcattaagacattgctgaccagaaaatccgcagcgtcaaaaatactgcggtgaaaaatagaaacatcactcaaaattccgtacgacagcgccgaagggatcccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagacggtcggcagcacgttaaataaaagctgcggaccttgatccggcttgagaccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgacccatcgcatataaaatggtgctggcatccatcgcgccaaaatcaggcatgaagaagaattttaatcccttcgctgcatcatgcagcgtaacggagcggatcattaaaagaataaacagaataaacagagccggcatcagcacctggcttaccttttcgatgccgctgctcaccccttttgccacaactaaaatcgtcagcacgataaacagcagctgaccgaaaaccgctgcataagggtttgaaatggtatcgataaataacgtatcaaatcccgaagaaagcgttaaaccgcctgtaaagccttttataatgtagattaatatccatccccccactacgctgtagaaggataatagaataaaacacgttatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttttgactgattgattggatgtaaaaggagctgtgtttatggaatggctgaaaaaaataagcgggtttgcgggccaaacctttggcttgtgggttatcgtctttgccggtttgggattcgcctgccctgatttgttttcttggatcagttcttatatgacgattttccttggtattattatgtttgggatggggcttactcttcaagcagacgattttaaagaattaatcagaaagccttggcatgtcgtgatcggagtcgctgcccagtttacgattatgccgcttgcggctttctgtttatcagtcgggctccgcctccccgcagaaatcgccgcgggcgtcattctggtcggatgctgtccgggcggtacggcatcaaatgtcatgacgtttttggcgaaaggcaatacggcgctttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttattcaaaaaacaggtcggacaagccgtgcacgcgcttcctctcgtatcggtaatcggcatcgtagcgattgtatcctctgtcgtcagcgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcggaatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgccgccgctcctatccttgtttattctgcagatcacgaaacaggcgcaaaagcgctttttttacatccccctgaaataaacctccatgataacaaatcaattggcggatatcgtaatcgagcagccgctgcacagatcggaccgcatcatccatatgtaacgtatagtcaggattagcaaggttcagctttccgtcttcaatgacgaccgcatcacctgcgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcaaatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacgatgtaatgcagcgagtgagccgatatggtctatgtcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgatagaatgcaattcttcattatattcaaattcgatctcaagcggataacagcttttcatataaattctccccttcgctcaataaaaaagtacactgcttgtaagggcagtgtactttttgtctgtctcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccgacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgtacgactgggacgacaagcccttcttcagccgcgacagcgataccgatgtcatagaattttttcacgatcagctcatcgccttgaatttcagcgttaaggagcgggaattttttcaatgcagccacgacggcttttgtaaagaacgacatgaaaccgagttttacatcgttttgctcaaggaattggtctttacggcgttttcttagattcataacggccgtcatgtcaacttcgttaaatgtagtcagcatcgcagaagtctgctgcacttcaaccaatcgtttcgcgatcgtctgtctgcggcgggacattttttgcacttcgacaggtttgtcaaagctttgctgtgttttttgagcctgctgtttcggctgtgccgcaggttttgaagccggtttttcataagcttccacatcttgtttgcgcacgcggccaagcgggtcccccgtcggaatttgtgatagatcaatccctttttcccttgccagcttgcgtgcagccggagacgctaccgttctggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggctcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaggctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgtccttcgtaaccgtgaggcagcagcatgaccagccctgatttttgtccccattttgcccgtcctgcagatatgaattgatcaaaatagacttgagccgcattggcaaagtccccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagtttgccgaacacgttaaaggattccggccagttgataagttcgccgttcagcttgcggagaacatcaaaatcaatggctgtatcaacgtctggaaaaccgttggacaccggctccggcaattcaatttcccgtacggcgtcttcttttttggcgggcacctttttataggcgtcttcaattcgttttgtcactgccatttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgattaaatcgattaagaaatctttattgaaccgcttccggtattcaaccgcaaatttaacggctgacaggcatgcttccggatcatccgcgttgacgtgaacgatcggaatttcataacccttcgccaaatcactggcatattttgtggatcgtgattcatcgctttcagttgtaaagccgatcatattattggcgatgatatgaatggccccgcccacctgatagcctttcagtgagcttaagttcagcgtctcggcgacaatgccttctcccgggaacgctgcgtcaccgtgaattaaaatggcgagcgattttgtttcgtcttgaaccgggtaccccttttgcgttcttgtttcctgtgccgcccgcgtgcttccttccacaatcggattgatgaattccaagtggctcgggttatttgcaagcgtaatccgcgcgcttttggtttcagcatcctgaagctgtctgtctgcaccgaggtggtatttaacatcgcccgtccagccgtagctgatgccggtcgatccttcagacggcacaaggtctttattcggcgcgtgctggaattctgagaaaataatctcatacggtttgccgagcacatgcgcaagcacatttaaacggcctctgtgcgccatcccgatattgacattggttgtgcccgctttcacagactgggcgataatgtcgtcaagaaccggcacaagcgcgtctaatccctcaattgagaaacgcttctgaccgacgaatgtccggtgtaaaaattgttcaaacccttctacttccgtcagtctttctaaaacggctgacagtttttccggtgaatttttccggaacagttcgccggattcgaccatttttgtaatccacgcgcgctcttcgaaatcatgcacatggtcaaactcgaaagagatggttcttttataggtattgcgtaaatgctggatggcttctaagccgtttgttatattggcaggtgcgtctttacagatgacagacgcgggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgcctagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacgctgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaatgcctatcctatgcttttatgaagcagttttttcaaaagcggatacagcacatcgggcagctgatcgacatccggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcgggcgcaagctgcatgatcagcggacccgcagcctgcagcagcgactcttcgaacggaatgacggtattgaagaaattcggctggctcgtttcggtcgcttcgtttgtatcctcccaaaatccgacgatttggtgagggacggacactgatttcaaggcttcatgaaaaagaacgatccctctttttgtttcatccattttgtcaaacatgctggccgaacaatcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagcgtttttttgtgctcaagtgttttttgtatcatctgcttcaggcgtttttgatatgattctatcgtttttgcctgttctttataagactgctcctcttcaggagacgctttatgaggcgtttgataaaccgggaaggcaaatttgttttcttttccgtcagccagcccggcgccctcatgttcatcctgaatggattcaagcgcttccagtttggagtaatcctctcttttcgtctgacgtgcggaaccttgaacggagccgagcgcctggtcaccgtcatcgccttctctggctgcgtctttcccaagatctgatttcgcgccgtgctcaatatcaaattgaaggaagctttttgacggcgcttcggtttcccggtgccacgtattcattttctcttcaaggatttcttcatctccgtcggaagactcagggagcgtgagatcgtcacttaacgaaggcgctttttttacgctttcgaataaaggcttttcagccgctttttcgtaatcaagttccggcagaaaaaagtaagtgttcagcatatctttctcaagcacttcatcaaggccttccatgaggtcttccgttattgttgcgatttgttccgtagaatccgcctcatacacccggatgagctgacgttcaatatacggtatcatcatatcaatattttcatgcatggaaggaatgccttcaagcggagactcagccgtcagcttgacaaacatcgcgcaatacaaagcgtcggtgaaaatgctccgttctaaattcaatgtcagctgcgtcgtgaaatatttcctgtacatctccctccgcttctgaaaaacacgtttcgttcccggccgttcttttttgatctgctcttcaattctgatatcctcgagcagcataaacagctgcttggcaaagctttggcgggtgaagtgccggtgaacgtcatttaaaaaccccgcaaatacccgaaatgagctgctgcgtgttccgacagcgcgcaaatagacatcgcttttcaggccggcttccatatccccggctgatcggtctttccaaaagtggctcatgtaaattttcttttcaaagggattgtagtaagactgcacgccgtattccacttcaacttcactgcttctggtcagtgttttggccagatcagtcagcatcatgaacaaaaacgaatcaatcgtgctgtcgttaaatttgataaacttcattgtatatccctcattcgaacagcgtttctgcaatatttctgacagcggctttttccctgtcgtcatcaagtttttccacgatgcctctttcaatcgcccgtttcggcgggatgtacgcagccaagtcgcacgtatctatgagagccctgatggacgccgcttcttctgatacttgtccgttatgcgcttgtgcgattaaatcagaagacagcgtcataaagcgctcaattaatttctcatcttttaagacagactgagaggtcagcacctgtttcaggaggcttcctttaatatacggaacatcaatgatgacaaaacggtttttaagggcttcgttcagcggaacggtgccgacgtagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcatcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgtttttcccgaacccgtcggtccttttaataagatattttttcccattgtcaaagcgatgacggcatcgaatacaattgctttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggctccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatctccggcgtgatgacccatcggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgatccttcatcatcagattccctcacttcgatatatccgatcgtttttccgttttgattgatgagtccggcatgctcacgatatgcagatgcttccaatgcgcggctttccccatgttttttgggcggaacaggagcggatctcgccccgcagccgcaaagcgtaattgatgcgagcatgagaaaaagcaagagacgattcatgcttcctcccccttatttttttacccatcagtcttgtcaaaacgtgaaaatggtaaacaaaaaaagccccgaaaggcttttttttaaaaataactgcgcgctcctaaataagcttttttccaatatggattgcttaagtttgaaatttcaaccccggaggagcttgcgtgaataaaatctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggcacgccgacatgttttttcgcctcgcctatcattctgtcaatctttgaccctgtcaccggaggttcgggagtatttggcttgtttggctttgccggtttgttacccggctgccgcgcaggctcttctgtttttcccgttccgttaatcaacagaacctgtccgatttgaagcacatcagttgtcagtttatttttttctctgatgagctgagcggtgatgccgaaccgattagcaattttccagagggaatcgcctgcttttactttgtaagtggatggcttctcagaagggtttgaatgagatggcggtgttgtgccgctgtttccgttatgtgaagaacctttgatctttaatacttgattcggatacagcatgtctgatgttaattgattcagctttttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgacatctgaactcaaacggttcaggcttctcagttcagaaacgctcattcggtattttttagcgatcacccataatgagtctccgtatgtaactgtgtaggcaccagtgtttcgttttcctttttgccctgttttatgtgtgccgctgccgtcgggaatgtgcagccgctgtcctgggtggagtatcgttgatttcagtttattttccgcctgcagggctgaaatacttgtatgatattgccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgttccttttctttggacgccgcctgttatgcaggattcattcagaagtcgacattaattccgattcatttgtcttagatcatcaccaatgccacacattttacataaattgagaacatttcacaaaagactttggaatcattttcataacatggcttttttccgcgacattccacctttcttgtctgtttttcatacaattctcttcacggcgtgaaaatcctcccgaaaaacaaacaaaaaaagcccgcttcctttaaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagttccgctgttacatcttcttttttaaacatcttgcccgcgcccgtgttttccacttggcttccgacggcgaactgatctgctcccatcggaatgacgatcatcggggttttgtagtaaagcccttcgctcgtactgttcattccgccgtgagtgataaataagtccgctctcttcaggatctcaagctgcggaacataaggctttacaataacattctcaggaatttcatcaagctccgccggatcaagatgtttgccgattgacatgacggcttttccgttaaagttcctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattaagccggctgaccgcttcggtataagccggataatgagatgattcctctgatataaggtttgtatttgaaaacacttctttaataaatgcttcattcattgcaaatgttgtgcaaagtgaatatgccggcagtttcagcttatttctcacaagccttcctgccagaaaatgatgatcataaaggatgtagtcgtatgattcatcttttacttcctcaagaatacggagtgcggctttttcggaagtctcaatcattaacagtaaaaactcggtagcatcccgctgttcatcacccgttgcgttttttccgaattcatcttttcggaaatcttcacattcacggaattccgctccgcttgacgcgattttgtgctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacaccaatacagaaaaaggtaaagatgttcaccttattaatattaaatgggtacaatattcccattttcttattatttcgtatgaagcgcccgcggcgaaacaagcggatacagtccgccgtctttagcaaaagacatttttcccgtttcttctgaaacaacgagcacgagtgcatcagtcacggccgaaagtcccatcgcggccctgtggcgcgtcccgtatttgagatcgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcgttccggcatcctcggtaatttgtttcaagtacgtttgaacggcagccgtaaacgcgctttccgtcatttgagtgtggcgcatgtcacatcatctcctttcccttattttctgcatcgcgcgcatggatatgcgccgctgtgtacaccataatcatgaaaggaggagacatcatatggaattcgcacggctgatgcaatatatctgcacctttttaggggtcatttcactttcattcatttatgccaagatgtttaaaaagccgaaaccggacaaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacacaggcgggcctttccctgatcacctttttggacacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacaaaaggaagtgccgttttccgtcatccaggccgtttatgtagcggccattctcagtgcggcggttatcctggtcggctttttcaccgttgatatgatcttgggacatttgggcctggaacctcgtgtccggacgatcgccaaacactttttaggctttttatccctcggtatttttcctttgtttgtgtacgccgttttgcgctcgttcattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccgtcagcttttttatcgtcttcagatttgagccgtttgccgggtactctgtatttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacgattgcatcccaccaggcggcaatgaattttgcttctctcttgtatatgctgccgctcagcgtatccatggccatgacgattttagtcggctttgaagcaggcgcaaagcgttacagggatgcccggtcatacagctatatcggcattgtgatggccctttgtttttctttatgcacggcggctttcattttactgtgcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagcaatgccaaaacataaactgctgtacgattatttaaccgaacgggcggaggatatcagtcagacatggtttgatacccttcatgatacggatcctgattctgtttatgcttctactgacccggctgttctcacaaatctgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattacagagctgagctcgccggtaattgtgctttttgacaatgtcggactgctgccgctgatcggggatattgacacggcaagagccaaaatgattttggagaatacgctgcaccagtgttcagagaagcgcatcacgcagctgtacattgatttatcaggcgtagccatgattgatacgatggttgctcaacagcttttcacattaattgaatcactcggaatgctcggcgtgaaagcgacgttatccggaatccgtcctgaaatcgcccaaaccgcggtgcagctcggactgagtttttcaaatttatcaatacggtcttcgcttgcggaagcgatcgcttccgacctgacacaaaaaaagggataaggcatttcagccttatccctttttttatcagtctttccacggatatgtccaatacacttcttcttcaaaccatgtctgaagaaccggctcgttattttttaatttttcttccagctctctcagcatgccttccgtttgggtgcggtgcgcttttaaggcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttgcatgcgtcaatcagctcttgctttcttaacagcggcagtgtttcacggttcgcgaaaaagggatctcccatgttccggcccatttcgccaagcgttgcgcatgcatacgtaacgggaatatctttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatatttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcagttcaagatcaatcgccttctccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgccttttgcccggaaaacggttcatgatacacaaatacgccaagcataagggtgatggtcggcgctatatattgcaaaatgccgacttgatacagcggcagacgctttgccccctctgcaaacaataacagcggcagggccgtaaatacgcctgcgaaaaataggagcgcccatgttcctgcccccaaggacccaaaagtgctcccgtcagctgtatatcctaaataaataagtgcagccggggtaatcaaaagcgtctccagcgtcagtccgatcgtgctggacatgcgggttctttttttacataagccatacagaccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatgacgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaaggccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcgtacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttcttaataaaatggcggataaccgccggctcccggcccgaaaccgccgtatgggacgcctccgtatccgtaaccggcaaacccgtacggatagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcgattgtaacaacatgtgcctctctttaatattgcattaagatataaacattttggttataatttgattatattttgattaactgttatactttttttacaagttgcgacattataaaaccatcaggaggaataaaatatgccattacttcgttttgacgttattgaaggccgggatgacgcagcattaaaaaaattactggataccgcccattacgccatggttaaagcttttgacgtcccagtaacggaccgttatcagatcgttcaccagcatcggcctcatgagcttatcattgaagataccgggctcggtttcaaaagaagcaaagatcttgtcatcatcagcattgtcagcaaagcgcgcaccgaacatcagaaagaaacgttatatcaactgatggctgatcagcttaaaacagaatgcggcatatcacccgaggacgtcatgatttccattacagaaaacgggaacgccgattggagcttcgggctcggtgaggctcagtttttaaccgggaaactgtaaaaggcctccctgcttgttttggatgatttcaaactaaataaaagagggatggatgttggttagtgagttgtatccttgtttgatatgcggatttaaaggattagagacaagtcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccagatgatgttccggcggaatgtaaaaatgatcatttccttacattcgatgctttattaaagcaattaaaaggcttgaacctcaatctgaacaattttgatattaatggtttttatgacgattaaacattatcattaagtaaaggctgccttgggcagcctttattattcatcacatgtgtcgttggcagatcccccgggctcgcaaaaactgtctgcccatttttgcatttcctgaaaaacggcttgcagggccatgcctttatcagtcagtttataaatgactttgacaggtgtttcaggcagcacctgacgctcgacgatttcattttgttccagctctttgagccgctccgcgagcattttttgactgattgtcggtatcgtttcggtcatatctttaaatcgtttcggcccgtccatcagtacatggataatgaggccgttccagcgttttcccaaaagagaaaaagcggattccattttaggacacattgtatatcccacgtgaattcatcccttcatctatgaattgacaagttttttgtgatccattaaaattagttttcaagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcgccttccgcctggaaccttcagcattggcattttcaagtttttcacagtgatgaagcaaaagctgccctgcttccggttgcttttaatcaaaaacagattattgattcatcagcagttattgccgtattaggcgacttaaaagcaaatgaaaatggtgaagacgtttatgctgaactggctgagcaaggcaatatcacagaagagattaaacaaacgcttttaggccagattaacggagcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaagaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcagactaagggttttttataggaatcgctcactgtaccaggcccgtgcctgctcggcttcctgctgtgtgagctgatgaccgccctcctgccattcaagagcaacggatgcatgagcatctgtcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgcggcaatattggcgccgtttgaatagccggcagcaatcacgttttctctgctgaacccgtacatttgcgccgcttcatcaataaaattctttaattcttccgtccgttcaattaaatctttctcgtcaaataccccttctttcagccgcttaaaaaaacggggcatgccgttttccgacactgatcctctgacccccagcagacttgcgttcggatcgataaaacgtccgagcgacagaagatcatgttcatttcctcccgttccgtgcaaaagcagcagaacattttctgacgttccctgttcaaacacatgtttcatcatcattctcctttctccattttgggcagaacagctgtaatctgactgcgatgttcttccagccattccggaagcttcagctctgttccgagattttcaaaggattcatccgtcataaagcccggttcgtcggttgccatttcaaataaaatgccgccgctttctctgaaatagattgaagtaaagtaagacctgtcaagaatgtcagatgaagcaagatgagaatcagcaagaatatccttccactccgcctgctctttttcgctcgtgcggaaagcgacatgatgaactgtcctgtaaccgccggcacctgcttctttcggcgcaaggtcaacatctataatatgtccgatccttgcctccgattgcagcctgacaatttgattttcttctcctgtctttgaataaccgaagcgttctatgagaaattgaatggttgcttccggacggtacgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagactgcatgatctgttcttttacagacaagccgttttcttcaagccggcgcttccaaaacgcgagtgctcctttcggcacggagaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacgagccgcaaacccagcacttcagtataaaaccgaagattttcagcaggatcttttgcaaatgcggtaacatggtgcaatccttgtgtattcaatgtattcactcctaaatatcttgatttcgagatattaactattctaatttaatatgaatgaagatgcaactaaagtgtttcagttaaaaaagtaatagaattcttttttttctgaaaaatatgttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcctttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggggggctcctcgtctggtttttagtcggcgcggatctctatacggcttatacgtttttaggcttaacaagcacagcctacacagggggaagcgttgctttttttgcaatcccgtattctgttttggcgtattttatcgcttatttctttctgccgaagttgtggaaagtggcaaaaattcacaaattaacgacgcttgccgattatgcccgtgagcgttttgacagtaaacttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcggaattaaagggccgacgtttacggcgattattaaagacattatggtgtgggtgattatgctgtttatggtcgtctcactcccgctgatccattttcacggctggacgccgatgattcacactttggctgaaaaagcgccgcatatgctgacgataccggactcggggccgaaaggaattccttggtttatcacagcttccatcgtatctgcgctggcgctctttatgtgggcgcatgcggcaaccggcgtatttacggcaaaaagcgcagatgccgtccgcaaaaacagcatgtttctgccgctatataatattgttttgattcttgttatttttctcggctttatcgcgtttcttgtcctgccggaagataccaatccgcggctcgctttattgaagctgattcaaacgtcttacggcggagtcgcacagggatttgcttactccacgatcgcccttgcgtcattgattccctgctccatcatggccatcggagcatcaaacttatttgcgaataacttatatcgggatttgattcacccgaatgtgtcaccaagcaagctgacgatgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattaccggtcttctcgtcggtcttatcgtgacattcacggtaaatatcacccaatccgcccacggtatatatgaagggttttggggtttgaccgctaacatggcagccgttattatccttaacccgttttttgtaaaaaaagcgtcttcaaacgccgtcaaagacggtttattcaataaagcgccctctgataaactgaaccaaaaaggcgcttaacagaaaaaagccggcacatcgatgtgccggttttttactttttgtgctgccatttgtaggtggcgacggttttagccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgtttggctccgcgctcgataaattttgaaaagttgcctgtcatatgaaagatcgggatattccaatagcggtcagggtttttagcatcctgaataaacagcgtcgggtccggggtgcctatccaatgatgcgtcttgatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacggaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctgctgagacggcggcatgtacatgctcggatagtcgatttccagcaaaggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcaatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccagttttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagccgcatacacttcggcttccgtgctgcttgatatgaaaaagaaaaacataagaaaaaccagggtcatgtgcagactttttttaaaaaacatgaaccaccatccctttccttatttttataagcgattctaaatgaaaagccggacagtcacctccttcccgttttaatgaatgcgctttcataattactgataaaaagccggcttcacacaacggtgaagccttccctttttacacctttaggatacatatgcgccgtttgtttcaatcacttttttataccattcaaatgagtctttcttaagccgcttcattgaaccgttgccttcattatcccgatcaacataaatcatgccgtagcgttttttcatttctccggttgtaaatgacacaatatcaataattccccatggtgtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttaccacatccccggtattatcgtttatcacgtcactttttacggtagtggacatgtaatagctgaatccgaggtagtccactcggccatttttcaaaatctcttcatcaccgtcttcaaagtgtatctgatagccttctctttcaaattcttttaacgcatagcttggataatatccgcgaacctggacgtccgggaagaaaaagcgctgtctcatcgtttcttcagccagcatcacatcatcggggtgagatgagtacgggtaaatcgggacatgtgataccatcgcgccgatcctgaactcaggattgatttctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattattgatttcattaaacgtcatccaatatttcaccttatgtttatagcgttcaaaacacacttcagcgaatttcacaaaaaatccgactgtttttctgtttctgaaaccgccgtattccctcgccaaatgcagcggcatctcaaaatgtgacagcgtgattaccggttcaatcccatgtttcagcaattcatcaaacacccggtcgtaaaaagccaacccttcctcattgggctccgcttcatcacctttaggaaaaattctgctccagccgatggacgttcttaaacatttcaggcccagctcgctgaataatgcgatgtcctctttataacgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtttatatcctcctttatttgactgccgcttgcataccgaataaatgcactgcagcagcttcaagcaccgcttcgcaggtgtagaagaattcctgccttcattttcatattatacgtttacattataattgtaccggtataatttatcaatacataaacaattatagttaatttacgaaatggcttttaaaaacgattatgctataattctgaaagaagcgggacaataaatgaatgaggaatggatatgttaaaataccagcaaatcgcgatagatattgaaaaatacatagaagaacatcagctgcagcaaggggataaactgcctgtgctgcaaaccttaatgacccggtttaacgtgagcaaaagcacgatcaccaagtccttagatttattagaaaaaaaggggattgtgtttcaagtgaggggaagcggcatttttgtcagacggaataaaagaaaagggtatatcagcctgctttctaatcagggatttaaagaatcacttgaagattttaatgtcacttccaaattattagcgctggaagtgagaaaacccacgcctgaggctgcccaaaatctgaatatgccgcctgacggcgacgtgtattatgtcaagcgaatccgatatattgacgggctgacattgtgtatcgaagagtcattttacaacaaatccattattacgtatttgaataaagagatcgtggcagaatcaatatttgattatattagagacggtctcgggttaaagcgcggtttttcagatttatatctgtacgcggggatgttaaatgaggaagaagcggagtacttaggtctgtttacaggagcgcctaagctttgcgttgaaacgatttttcatttaaccaacggccagccgtttgatttctcaaaagtcacctatcactatgagcaatcacagtttttcattcaggcgaacagccacctttttgaacaggaaacgacataagacgggcttttcgcaaataaaaaacaccccatgcgcgagcgacgcatcgggtgttttttactatttcatattcttatttaatgtttcaacggcttgtttcatttgtgtatcgttgtccgcaagctgtttttgcagatccgtcatcagttttgccgttgtgtctcccgttaaaatacctgtttgtttcagcttctcttttgcttggaattgtttgactgcttgttcaaatgctttattatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgatgccttttttatggatccactctccgtccgctgtcagccattttgcaattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacttctttcgtgccgtctttgtattcgacctgcatgatatttttccctttatcgataaacatgttgctcattttgatggcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaataccgatcatccagagaactaatcatgccttttatcgctccgtctactaatttgctgtcatctgttttttgatagtaatcacttttaatctgctcataggctttattgaatttctcaaatttgctgttcgtcaaagcagccgagccttgtccgaaaatggtcgtattgcccgtgataaacagcgtaagcgctgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcaccccggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatccccttatgcttgaaaaagcagcaaaacgatttgccgctgaaggcttaaccattccgggctatttagcggagcttgagcggctgccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacgcagataaaagacttctacggttttaccgtattgcaggatgaaaccgcatggaaacagagattgcttcagcaaggctttcagaaagcggatttcattcccgctgtctatgaaaacaatgcgcaggagccgactacagaaatggatttatcgcccgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcacccctgtcggcggccgtcacagagggtacggattcggttattggggaggaggctggggaggctggggagcagcctacggtatcggccttggtttcattaccggatttgcgcttggaggtctgctcttctggtaataaagaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcctcattcagctcatatccgttgcttttgctggaaatgtccatggcaagccccgtctggtgttcgctttgccccggatatgcgacggcttctttcgcctttttttcacctttcagactgacttcattatcgaaaataactttctgtctgtcataagaacggtatcctgaaacggcaaccaggtcataaccttcttttttcccggcgctgaatagttccgccaaagcatcggcggccggtttgcggatatatcgtttctcgattttctcagtaaaagaaaattcgactttcgggattacgagatcattcggtttataatctcccggcagcgtatatgtcttatttacgagcgcaagtgtatttgtcgggttttgaatggtctcaagcccgttcacttctttaatatcattaaaatatttgctctctaatacaaaatcactgttttctgtcttcgttgtttttttgcttgatgtgtcatctgattgttttgtttcagctgctgtttttgtgtccttatggctgtcgccgcctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatctgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatagccaaaatcacgtcacgcaccttcacgtcattacggatggctccgcatgagccgactctgattaagttttgaacatcatagctttgaatcagttcattcacataaatagagatagacggaacacccatgccggtgccttggactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcattgatcagggcaatcttgggcagaatatgcgggatgacaagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaatcttcagccggctccgtcttacctcggctggacgagcagccggttaattttactccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccctcttatttcttaatagtattagcgttttttctcatttttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgagggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaagagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggacggcttctatccggatcgctgctgcgagcagaataaacaatgcgaaaagacttgctggcttgtacaacgttttccccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaaacaagccccggagggagaaaagataatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccatatttcagttctgtgaccgataactcggaataattcctttccgtagtcctttacatatacgacgtcgccgatcagaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccataatttcgcatgggcatgaaaaccacaggaaatatctatttctgcacctgttcaaaatggcaaaaaccccaacatgcttgtgcgttttttcacttaccgtaacagaagcgtctgatggcattgcgctctcgatcgaatgagcagtaacaatgacgagacaaaaagcgcctgtttttgaatgagtttttgtttatttctccatgacacaaagataaatacccggcccgaaggcatgttgacaatatcaccgccgtgatgttcaaaatttgccgtgaaacacatcatcgaagatgtatggagatccaattccggctgcatatctgcaatggcttgtttatcatgaagaaccaaactcgtttcggctttcaatgaagccacaacttcaatccgcttcaaccttgtcacataaaattcccttttccgtccaaacgtcagtgcctcaccatagatcatttgattcctctcacttcatttaaatgtttgattatttctccgtgaaaagaggctccttacacgggaccccgccggcagcaggtctgatccggtgaactctgcagctatacattctgctgccttatgatccgtgccatcaggaagacttgtttacgcgctgatcaaaacgaaaggcattgcgggatttgatcatacggcacctcataagcgattgatttcaacagaaaaaaaccgcacaatgtgcggtttttcgtcaggcgtgatgcacctcggtctcatatttttcccaagcttcatcaaatgtcgccatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtccccatcagctcttgatatgtgagtgtttccggtaatttttttgcatcgactaaaaaaagctgattttcgatttccgctatgaccgcttcctcctgatacgtcatgccgcaggaggagcaggcgaatgcgggtgtttctgtaatttctatggctctcgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttcctcctgtcgatcctcgatacattttccggtgtgaacgaaacctctttgtccgcgaaaatggcgctcagtccgacaggctcgcgtttggccattgttcccggaaaaacagattcaaaatagtcgtcagcttgattcgggatatagttttccggctcgggataagatgtaatcaccccttcgaagtttctgatcacaactttctccggactttgggagagcaagtagttcggctgcagggcgattttaccgcctccgcccggggcgtcgacgacaaaggtcggcacggcaaagcctgttgtgtggcctctcagtccttcaatgatttccaatccttttgacacaggcgctctgaaatggccgattccctctgacaaatcacattgataaatatagtacggacgcacgcggattttcactaaatcatgcatgagttttttcataatcggcaccgaatcgttaatgcctgctaaaataacagcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcaggtttttcaaaatatattccagaatctgatcgttaattaaaagcccgtctccgccggaaatcaggcagtcacggatttccggcgtttcccggatgtaagcgattgccgcatcgagctgttttttcggcacccccattccgatctgtccggaaaaacgccttctggtgcagtatcggcaatacatcgagcattgatttgtcaccagaaaaagaacgcggtcaggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttttcttccggcacatctttccacaattcaatctccttccagtgacgcttcggctgaaaccatttgtttgtcaaacgaattcctccttatgaatggccaaacgtaaagttttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagaagaatgattccccggccagcgagttcctgctccaacgctttaaacaagtgtgccgttacggagttccccctgtaatctgacagaaccgcgcaatcggtcatttctgcgtgccccaaaaccggattgatatctgcgcttgccgccccaatgagacgatcctgatcgaatgcggcataatagatggtgttttctttcattgtttttttaatataaaggggattaaaaacaggagtcggataggtaagaaaaacatgtttatataagtgcgttaaacggtccgcatcatcttcgtccgcttttctgaacatcagcgtgctttctgtctgagtcattccccgccgcggtgtctcatataaacggtcaacagccgaatcttctgatacatatgaatctgaccgtctccgttcctctgataaatagcgcaccatcacaacagccttatgcccgttgtaatacccgtctatggcaccctcaataataaaaagatgcttgacaaattccggctcatcgccgcgcttggcaaagaaaatcaccttttgggctccctcttcctttgcttctgccaaaacggccggtataagcgcctcgggctgtccgtcataacgaatgaccctgatccgctcgttgaaacggtctgcatcaatctcggccgctccgctttcagccctcagttcctttatcagcgctgtcacccccatctgccaccccgcaccattccatgataaaaagagaaatgattttgacggcatcgattaacgcccggacttcaatgtattcattcgcctgatgcgccgccttgacttctcccggaccgaagacgatgaccggcgtctgtcccgcgtgctgcaaaagccctccgtccgttccccacggggacgcttcacgaaccggttttgcccctttcattttctcaaaagaagattccagagcggaaatcagcggatgctcatccgggagatcattcggaagccactgagccccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttcccccttggacggtgccgatattaatgggaaccggaatcggaacgtcccgataaagcgggtctttgatacgggcgttacggacgtgttcaagctctttaagggctgtgatgacatgcaggcttttttcaatggcgctcaccccttcatagcgggtgccgccgtgtgcggacaatcctcttaccgtaatgcggaaccacatggacccttgctgcttaacaaacagctttaaattagtcggttcgggaataagcgccccgtcagccttgtagcccttcataacagccgccagtgttcccgcgccgccgcactcttcatctacgacactttgaaacagaacatctccttttaacgtaatcccgcaggcttcaagcgcttctaacgcaaacaagagggctgtattgccgcctttcatatccgttgaaccgcgtccgtaaactttgccgtccttttcaacagctgtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaattgtttgacactcggctcccagacatcaatatccatgtcaaactgtctcagtttttctaaaacgactgcctgtgcgttaaattcatggccgaacgtgcttttttccccgatcagccgtttcagcaggcttaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagccccatcatctatgctgatgacggctttctctgtaatgatgagatctgcacagcctgctgctgtaagcggcaatgaacagctttcgaccagcttcggccggcctttctgatcggtgtggctcatgacgacaaccacttttttcgcgccttgggcaagctccatcgccccgcccattccgggcacctttttccccggcacgagccaattggcgagatcacctgtcctgctgacttggagcgcgcctaaaatggtaatatctatcagaccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagttcggcactaaagaaggaatgccgatccccaggttgacaatcatacctgaggtaatttcactggcggcccgcctcgcgatactctctctttccgctattcccaagcccatctccacttcactccttcactttgcacgacaccctccacgaaaacgcccggcgttacaatatgctcgctgtcaagttcgccggcaggcacaatctctgccgcctcagcaaatgttctttcggccgcagcagccatcagagggttcatgttgcgcgccgttttgtcaaacgtcagatttccgaattcatcagcaatatgtgcagacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcctgcgacaggatttgagccgatatgggaagcgatcagcctttttacccgcttatgaacgataagcgggccgataccgatttccggaaatccggcatcattgcagatgacggtcaattctttaacgccgctttccaaaatcgcttcgattaatgacggaggtgaacccactcccccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaacggcggggcgatgatgacggcgtctccttctccgctgtcaataccgggctttgctgggtaaataagcaggccccgtttttttgccgctttaatgattttttcggtaaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgccctggcacagtatgggttggcactgtacgtatgtccgctcataatgaccccggagccccgcttgatcgtttcaatgatgtcatcagacgcaacagctgccgcaatcggagcgtaaccggcgcccaacccttttccgagcaccgcgatatcaggggcgatcccccaatgctcagaagcaagcatccgccctgttctcccgagccccgtcatgacttcatccgcaataaacaaaataccgtgcctgcggcagacaacctcaagcgcttcataataacctgccggcggagtgatggccgccccggctgctccgacaatcggctctgcgacaaatcccgcgataaatgaggaaccgatccgctgaacagccgtttccagttcagccgccgcagctttcacaaattcctctccctgcagctctgaacgatacatattaggcgctgaaacggccggaaaccgttcaagcagctgggtgaagcggtatctccgttcatagaaccctgataatgaaagcgctcccaaagtaattccgtggtaacttccccatcttgatagaaagacggatttttggtattgccctttttcctgccaatattgaacggctattttcatcgctgtttcgactgcctctgagccgctgtttacaaaaaatgaccaattcagcccgcccggcagatgatcggccagaaataaagccagttcttctgccggagtactggtgaattgcgagcgatacacaaacgaaacggagtcaagctgctcttttaaagcttgtataatatcctccgtgccgtgaccgatattgcaagtgaccgcccccgatgctccgtcaagatacttgttcccctcctgatcatacacatatgatccctttccatgactgactgacggataatttgcgtcaagctccggtttgattaaatagctccccatatctttccacctcgaaaacccatttgcttcattgtatgaacagatgaataaccgcattctttccttcaaaaagttttttgcagaaaatacctttctgtaaaacaggctgccggagatgtcccgacagcctgaagagcgttctggaaattctattactactgttgattttattctttcttcggttctgctatttatctgctcatcccatcatttttgatctgaatctgtataagcagcaggcggaaaattcccgtcttctttactgtatgggaatcaatatttcacacaaatgatgattcaccttttgtaaagtatacctttcgataataggctgttctctgattgataaattatttttttcgatctcagaaaaaacagtgttccaaaatccgctgactgcctcttttgtatgatcaagcaagaaaaacagcgtacttccctccggaaaatgtaccgatccgggctggttcaggcacatggtcttgattgataacaagacaaacatcatagcggcatttctctttaggagtacgattcggatgatcttgcggaattcctaaaatgacagaatgatcaagcaggccattcaattgcgcccagtttttaaatgactccatcagttctttgttttgctttccgccatactctccgacgtttcggaaataagcaattctggattctggtaattcttcaatcgttatgttcacatttccccccccttctccagaaaggtaatatgtattaaaatgtttttcaagctgatttttcagcatggaaataacaaaaagcctgcagaaaatgatgttctctgcaggctgattttcattataggattttttcagtctaacaaataaaagccgcaccgacgatgattaataaaataaacaataccacgatcagcacaaaagtgctggttccgcctccgcagccgccgtgcccgtaaccatagccaaaactgccgcaaccgtagccatatccgtatccgtacatacgcaaatcatcctttcttcttacgatatacggcattgtatgcgggccaactcccaattggtttatgcgaatgcccaactatgtaagaaaataatgaaaaattgtatgcacgcgccgaaatcttttgaagccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccctccttatacaaaggatatttccgctcaagcttttgttcggccgccgcctcgccaatgtaaagggcatcatagatgttcataatagacgacccatcggcgaggctcttttccgtcccccaagcagtgagcgggtgtccggcctgcaggtccccattttccagtttccttgcaaaaaacagctcatcttccactacgcagccctgctttaccaaagtttgtttcagaagaagcggaaatgcgtgctccggagacgctttcacatgaatataattggcttgaagcatgcccggaacggacgaaagaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttgcacatccgactgcatctctcaaccttttgttatattgagatttcttataatttcatcgtacaccggatagaacggcattccaattggtaattgtttaatttgctgaaaggaaatgggtatcgccttctgattcgcaaaaaagcgtttcgctacgtcatgactgatcggatggagaacccctctcaaataaacataaaatttccgttcaatgcgaaacagcatcctcccgggcaaatgttgaacacagtccgatgtccaccggctgatcggcggaccgtccggaagcgattgtatttcggcccgttctaaagccgggatgccatgccgtttaaatcggtaaaagcgaaatgcgctatgatcaaccagccttttctccccgtcttctataaaataaacatgaaactgatccctgacgagctgaaaattcggaatactggcggagtcctcttcctcatattgaaataaaaacggatccggaatgacgacggtccggccttcgtataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatgcataacatcttcgtcccaaaagctgccgaacttctctttcacacgctcaagcaatgatctccggtgcatcactgaacagtgatcaacgagaaaagcggcctgatcaagcacctcttcagcaaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcggccgaggtttcttcatttgaatgatcatccatcacaaacagctcccaattgctgtaggtctgatgcaaaacactttcaatcgcctgttttacaagatccggtttgttgtaactcgttaagataattgagatcttcttttccatcccatcaccccttctgtaaaacgtaaaaaacggctccgaaagagacagagcctgatatcgttattaaaaagccccccagctgacgatgcttgaaatcgcgacgtttgatctcgtattattgagcggattttgaaaaacggccaaatctgacagcacttctttgacaattacgttctgcagtgtgctgccgttaatcagattgacgcgcgacacaggaaccccaagctcttttgccattacaagctgacgccgcaaatctgaatgatctccggacggctgatgagataacaaaagaagaagaagcagtacgagctgaaattcctcctcaaaacccccgtgttttacagtttctcctgaatccaaaatattcctctccttcattttttaatctatacaacgtatgtcatactcttacaatccgcataggcaaacaaagcctgattcgaaaattcagctgtttgattaattattgaaaaaaatgcaagcaaaacggcattcgacttataccaatcttttcaatcaggaatatgaataaacgtgaggttgaaattgtaaaggaggtgtatgtccgcatgagcgaggatcgtttggagcttaaaaagaagttattaaaaactcttttagcccctgtatttgacaacagcgctttatctggcggcacagatggaggagataatgtggaaaacaaagtaaaagatttattggaatcggcaattgatgcaaaagtggatgaagcagcggcgaaagacagtctcagcgcacaatctgtattgggaagcggtatttcattagcggcgagatggatttttgcaagaattcagcccggcactgtcatcagcattgtgatggattcaggagacatgatcggcccggttcaatttgttgcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtatatctatggatgacggaggatcctttttatttcgatgtgagtatgacaatcgcgccgcttgcggatgccgttttaacgatagaacaaaacgcgcttgatgcttaccggcaaatgggcttacagcacgtatattatgtcccgatccccgttaatcagcggctttttaaaaaacaacctgctgaagcctctcttcacacaaatctgcttctgatcggatacccgtatccgaaccgcgttgaactggtgaaagcagcggcgaagcttccgtatacgcttcgtattatcgggaagggatggcgcagacatctgcctaaaaaaatcgccagacagcaaaatgtgctcgtaatggatgaatggattgaacccgaacttgccgcattatattacaacagcgcagaggtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcaacatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccatcggcacgatcgataaccgttccgttactgccgccgtccggctcagcgctgaacttccagatggcctcatcttcttctgcgatataaagactgccgtattcatcgtctgctgccatcccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtttggatccgtaatgctttgtaatgtgccgtttttcccgtcaatggcgtaaatctcaatggtattctttccttcagaccgattggatgccgccgcaatatcgactttttttccgttcaacggaaaatcataacggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaaccggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcactttaattgtaaaatacatacaggaagttcagtgttaagtttttgtgaagattgtccgaatgtgaggatttatgaagagaaaaaattgacgtgagcaaatatttaaaatgaatatttagtacaatgttttatttgtaatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagtaaacaatatgtgatgaagcaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagcggctttgctgcaagaagtgacgcatgtgattaatatcagtaccgataaagccgtttattaagatacttaccacaagcaaatcaaaaaaagaagcttactctgcactcctttccaaagcagcctccaataaatgctgagcaaattgtttataaaattcatctaagtcattactcgcttcatcctgatctatatagcggatactgtaattatctttatggacaacctttattgttttcttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgggaatgctggctttattcaaggtgcccagtaattcaaaatgtgttcttgacatatgccttctctgcacctgagtcaacaattgtcaaataaatcccggggcaggaataagccaccgcgaatgaagaatgacgtgaggtttgaagacaatatttcggttcaatatgccgtttcagttttgcagcggtatttctgagaattaaagaataggcactaaatcctttcaaactttgagatatttgtttttggcggtgaagattcatttaattttttataccaaatacgaattttttgtcctttgctcaagtcatctttattgttaagttgactaagccccagtaaaactatatccgatctatacttttcaataatctctttttcactaagattttcatagtctttaacatcagctttttcattatgtatgaaaattgcttgattctctccttttaaaatgacatagccgaccatggtttgctcagcctccataaaatgtttgttatgttggttttgacaccctaatgttatacataacaaaattaacagcattataaacactctatacaagttcaaaccgcccttcttgcatatttgtaacaagagtaaaacactgttttaggaaatgacagactagaacgcctcattttaaggattttaacaatatggaacacggcgaggcctttaccatcatagaaccgcacaattgcatcatgaaatattcaattggctgatcaaccacaacaccttctttaagcggtctaatgtggaatacgtgtaaggaggcggtttatttgaaaaacgatcagaaaataacacttgactcttcttttacgttatccactcttattgtcttacttattgcattgtacccgtcctattcttcttggtttgtcacaatattctttttaggatttgcactaatatacacatttgaaaaaagagcaaatcttcaaaactaattgctattatctcttatccattatttattgttgcgtttgtttacagcataataaacagcatgtaataatcccccgcctaaggcaggattattttttatcacattgcagcagcttttgagccgcctttgtctgtgatgttaaagctgtcactcccgattttttctttcgatccttatcttcataaatcgttacatggtcttttgtcattaaaattgccactgccatcttaaattcctgcctatccttaaagtaaacaattttacattcacctagaatgatcattagctaatccagcttaataagatgatcatccccctgtaagcaaattttaagcaaatcctaatgtttaaacgacagcagcagttgagtatttgtcaaagttgatggtagacgttgctttcagtatcattcctagtctgagttattctttcgcattaactcctgccccaaaatcataaagcaaaccacttcagtaaaattccaatcttgtcaatggtgtttctcaaacctaattccccctctgagtgttttaatgatattacactcagacgttaccctgaaaatattcataaaaccatattgtatttaatttttcctgaactgcaaataaatcagaaagctttctttctgatactttgatatcgattttatataaggtatcaaacaattgtttgatagctcgtcttactggtgcttgctatatcaagattctttcttttcatgctgctcttttccttggcctcaattcattaaaattacgattttaagttaactttaaactgcattatgttgagaatatcacctttaattggtaagctgacaccagatcatacttatccaatgaaggtgaaatcatgaataaaataatcggaatgaccggattaattatctccttacttgtgcaagggttttcagcaagtgattcattgactcataagatcgccatggcttgtctatttttgttcttattgatttataattttaaccatactaaggagttctctaaaaagtctctcgctattataagcgcttcctttattgtgctgatgcttggaatttatcaattgctcttttttactgaggattactttgaaaggcgcggtttgaattttgggtttatcctcttacttgaaattgttttagttattgcattagtgactgctgcgctgagtttaattaagcatattgcagaccgcttaaggaaaacacctgatggtaaagagcgttgactctttgcctttttttagctaaccacttctttttatgccgtctttctatgtacaaaatcaaacgcaatgcaatatcgacttttgccggctctcttctgtcaaatgatgaattgacttcaggcactccatcttaacggactcttcatcattttttaccagaatttctcgaacaattacctttttttacaatttacaaaagatccaacgcactgctctctttgataagagctctacatttctaatagcaagattgaatattgtttgttaatacactcggccccaacttttgcgtcttagaatttgaaaggcgtacttgcactttaacatttgtcatttcagccgatatggaatcaatccttccagcccaattagggctctctttctcgggagtcggatatagtttaaatcgccaactgatctcccctgttttggaggcaaatccttcataaccgtcgtagcttccataagaagatggctgaggaaggtggacagcaagaatactcatattcgttctcgcagcacttggcgggtataactgcactttatagattagggccgcacccttcgcatttttcaatttttgattcaccggttcgagtactgcactacaaggcattggacttgctttcatttgagttggagagacaatcacagcagccaataaaggtataaccaagataaatcgtttcatctaaattccctcacatttttttgttaatttcccttactcccgccttgaatattcatcacttttgaatggttagcttcattaaaaaggcagtactggagctactaacgctgccggtgaagatggaaaatcagcatatgaattagccgttcaacaagcggaacattagatgagtggcttgcctcactgaacgcaacagcaaactgatcatgtacccttctctaacgaggggggttctatcgcattccacaccgaattgagaaattaagaaaaaacacccttcccaacatattacattatgataaaatattacataatcagacgaaatactaggaggttgatttttttggagcaattgatctcttcttcaaaggttggcttaaaaatcaatgaatggtacaaatatataagattattcagtgttgcagatgcagaaattctaaagggtgaagttgaacaagaaatagagcatatggaagaagatcaagatttattgttgtactactcgctcatgtgttttcgacatcaattaatgcttgattaccttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacagtacgaatatcttaaagcaataagtttttacaaccgagctgaaaagaagatatctattgtccccgatgaaatagagcgagctgaatttcactataaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccgcggttaataggttcttctttgtacaatctcggtttatgctcatttacaacaggacatatggagaaggcattggagtattttaaagaaggcgtctcaatttatcaaagtaattctcttcgcaattctagccgactgcttgacatacttctaatgttggcaaaaacgcactttaaattattcaacacggttgatggaaaacaggtttgtgaacaaggtcttatgctgtcaaaggagttgaacgatgacgtattaggaaaaatgtttgattttcttatgggtttattcgttgagaatgacaaagaacgactttttaaaatcttagattacttagaatcaaaagctatgctttcagatgtggaagacctagcgactgatgcagcaatgtattataatgtaaatgaagaccataaagtagctacagccttttatgagaaagtgctttatgcccgaaaacaaattcagagaggggattgtctttatgaaatttaaatttgcatcggcttttatctttttggttatcttacttgggcttgttggacattatcttcttgacgtccacaaagtttttaaagaagcccgaagaggccacacagccagtatccatatcgcgcttgatcaccataatgacttctcagcggaacgccgagggcaaaccgcataaatgttttggcactcccgcatagggggtgtttttttatgatctgtgttcacctgtagagctctatgcaatgctgtccttcatagtaaaacaggtaagccttattcatagctgcaaccaaaaaaagcacaaataaatagtattgctctaatcttgtgtggcaatcatacaaaaacacaaaaggaaccgacctagacagtaatggaggcgcacttgtcacacctgcagatattgaccgctcatcaaaaactgtctgctcctaatcatttactttgcagatttattctgcaagtgtctttttattttatataaaagataaggagtgttatatgaaaaagtcttatgttttatatgggatttcaggagttctaattggtgcaatagttatattgttgatcaatgcattctttataaataaaggtgaacactctgtaagtacttctaaaataaatccaaccgaggataaaatcttttttatctattcaaatccactcatcaagaaaagcgtactcatatccacatcacaaggagaaaaattcaataaacgatactttaaggtaccggatataccatatatccagaaaaaaaccccctcttcagacgatatcgtcttgttagctgaacatgaaccatattattacacattaaaaaacaacactattaaagaacataaattatccaatccatttgctttttggtatcaaggagaagatatttctgtaaaagcctataatgtcgataccaatggaaatgaactgaaagtaaatgataaaaagttcaataaaaaatatagcctgactttgcctaccctcgtaaccatgggaggaagcgataataggtatatttacgtcattcaaggaatgtctatgtacgtcattgatagaaacacagaagggattattaaaacgattggattagcttcctatggagatgtatttgatcactctgaaaaatatgttgtagctagctcagaacatgaactaactgtaatcgaaaaaggatcatggaaatcaaaattcataaaatatcctgatgatctcgaacaagcggacgctgtgtattacgacaaaaaaagcggtaaattttacgttacataaattaataaatccgtatacgcctgcttacttgagtacgataaagatttttcttttgaaaaattcgatttaaaatttccgtatatgaatgcaaagtttaaagatcaaaaactttatgtaatttcacaagaggaaaacaaaaaagggattggtggctatatggggatttttgatatccgtactaaaaagaaacttaatgaatttgatttgcctgaagaagaaacaaaagtgcaggacttaatggttttagattaaacataaagaataagttgcaaagcaaaagccccttcctgaataaggggctttaattttaaattaaatagatgttttatacgcgttaatggcttgatttctcaaaagcatattatctttcgtaaccattccaagattgtatgcttgtttgatgatatctaacacttgattatcagtttcagttacagctcgtcccccagttattctggacttccagtaatcaaactggtgatttaactctgaactgcttttaaggtttttattatcaactactttgccattctccagcgcttctttgaattcattaaaaccaattgaacattgcgtattcgaactaattcctgcaccttctgtcgctaaactgcaaaacgctaaaaatttcggatctttcgtgatattgtaagagttatttagaccttccataacattcatcctctctcgaattttacaacgttgctataaatgattttcatgtttttcccaagaccttcaacttgaatctcatttgaaggaagttcgttcattggaatttcaatgtatttgtcccatcctatcacaactttgttttgtccaagtatagggtcatatttgtatatgttcgcttcacctttgtataacaaatttttcccatcctttgctttaatgacggtcgaatttgtatagcccataaagcgaactttaatatgcagcttgtcacctttcaaaacatttgttgcatttggcttgctgcttgtaacaggctcccatacaaagtcgtttccatccgatgtgacggaaagaatctgaagactgtaaagcggtgttgcttcaattgcttttgctttcgatgtgctaatggaaaacatcattgtaacagcaagaagtgtaattgttactaaactaagtacttttttcaatcccttaacctccttggtattatttcacatgttatttatcggtaattccagccgattatttaactcaaattcaaaaaagaacctgattctaacatggttcttttcgcataggtaactgaatgggtttttaacgacatataaatgattcctgtacattaagtatgctcacttaagggaatcttggagtcttgctcaccccctatagaaagggggtgatgcttatgtcaacatttcaggcattaatgtgaatgcttgcatttgggtcgtttataatcgccctgttgacgtatataaataaaaaatagacctcccttgagcctgaaaacctgaagggttaggtctatcatgaataacataacatctgagcaagccctttgatggggtgcgaccaacaccatgctctttttattttatgcatttcttgttaaagaaatacactataaccagtctgtattttacagattgattataacagattaaatgaaaccattggaatggtttgcaaaacttttgtttattggataaaatcattattgtatttggagccgataagcatctttaatgtatcaatgcgctttataccttccaaatacttctcatgttgtctttctaaaaccttaatatcctttttaatgatctcaactttatattcttctttaacttccttagataagttatcgtttagatagcgtcgtaattcttcttcattttttgttttatccataccaattgatatgactgggtctgtttctccaattccaaggctaaataagccaaattcatcccatgcactttctaatacttcctcagtggatttttgatttttaaaagaatgtgtaactgcgccatacatgaacacagaaaaacaaacaatgatcaagaccccaattaatttctttttcattgtctcctcctttcatttcaagaataccataaaatacaatacatggaaaaataattcctcagccaacagtatcctagttcattacgggttggttttgagaggataaatgctaatccgtatcttaataacgatctaattagattagcttaagttaccgtctatcatcgtttgtgaaagtaacctcccacacattcaccataattctcgggaattttattttaatactttaaggagttttacatattcatcttcaccaagaaataatacggttgtaaagccctttttttcatatagatgtcttgcgtttaagttatctgtatctacaccgagtgttatttcctcaaatccaagttgtttagcataatcaatcaaataatcaacaataataccgcctatcccgcaatttcaatatccttctttaacaatcatacgagatagataaatgcgtttatccggaatggtataatctgggtcattgttttgaaaaactaacgatccttctcctataaactcgtcattcactgagtaaataaaagtaattctgtttccgcttactaattcgtcataaaacaccttagccattttctttttcttttccatgtcccaaatattattacacttatggtattcttcgggttttaatttctttacttggtacgaatccataacctctctccctttttataattagtttctatcgaaaataaaaaagctctctttctgagagcttaactttgcaatacttttcctaacaataaaagctaattgtccttacaattttgcaaagtcattgtctaaaacctcaatttccacatcactgtcattatcatcagtttcaattggttcatctactaaacttagaataaactcttcaaaagagttggcaataaggaaaaagtctttatcggggtgacttaattcatgatcccaaaacaatatcttttcattatcgatatccatggatatttcattcccacctgccgagcttgctataggaataatgttcctaggaaagcgatcagaataagtattgattgcttcttggagactgttatgatcgttagctaaaccatagaagctctctattaattgtgtatcatcttcctgacccatccaaggatctttctctataggtttgtagcaaacgtcatactcaatctcatctgttgtttttttactttctaaataacagcctccatatcccttcaaaaaatccttatagtcggaaggcaattgattacctatatttctttcaatttctttgagctgctcgtttgtattaatgctaggatctgtgccagcattaatcgtaaactctttcaacttttgtttgatcttagtgaagctcattttaatactccttcatatgctatggaaaaacagatatagacattctttttagttttaatcgtcccagtcctcatcatcgatccagtcgtctttcgattcttcaagctcttctattaaaaactcttggaatgtcctagcaacttgtttaccatatccctcttggttatcccaaagaatgactgggcattctccatctatcatcttgttagtgtcaagacaataagaaaattcatctacatattcgatcactacaagaccatcggaaaggttataatattttttatattcattggtctgctcgacaacttcagcgccgtgagagtcatatccgagaatcattgttccgtatgctccccctgaaccatactcagttaaaaaccatttatagctgtctggaagagttacattgagctcctcttctatttctctaatctgatcttcagtgactccccccgtgagaattgaattttctttattttcatcaaagaaagtttttattttcgaataatccattaaactttcacctcttattcttgattctcaaattgctgagctctccatctccaataccttcttctgaaacttttatattgtttatcaagcacaggatcatttctaaaactctgtccattcccttttaatccatgcaaaacatcactgtacttattatgccagctttcaggtatctccagcatagtaccaggctcttcttgaattaagtgatgtaaatttatttgcgtgccatctttagcaaacggagcattaccatttttcatcagttgaagattcgtaaagcctttacgatttttttgattaaggtcaatatcttttattgtgtatactctacggcttacatctctaggctctcctttaacttttaccttgccgtctatttcataggcctcatacttctctttatttaaccaagggacatttactttctgaccagtaaatggctttctgctttcatccaatttctttgcactggacaaaagtccatttttaaggttttggctgttaaccacattgtatggtacgttatcagccagagcaagatcatacttagtgttataaggaagcaaatctgaaatcttaatgtccttaattttctgacctgcctgtcctgccttgtttatgaccttccccgccgcatcagctttgttaacggctcctgcgccttttgttccgacgacagccacagccactgaaccgaccgcatatgtcacccatcttgatctggagtaagcatccccgttcaccatatctttttgatacgattcctcaatagctgttgaaatggcattatacgtgttaattggatgggcaactgcccctatgataccttcaacaacttcatcaggcttactgatcagctgccataaaccggttaccgtgtctttcccgacaccataaaggccgacgccggctccttttaaaatatcccaagtcacttctccggcttcttccagctgttttgcttgttcaagctggatcacatattgctgttgggaaagttcaaggttcgcgtacccgatcttcctcgcaatctccaagtattcatcaggatcagttactccatcagcgagctttttcttcagatccttgatttcccgctctttcgcttcttcctttttaatcgtcaaataagcatccgaatgtcttgtaatctcgctttttttcttatgtatgtcactttctctgtacgccttagcgttatagtgaagtggtgttgcgtttttccctttgcccgtggcattttggagctgctggaagtcggcttggatgaactgttcgtttgcttcggtttctgcgtattctttcgttagatcgtgatcgagctttccgagcttgtgtatggtattgtcccgtttcttgtctgctgagtccagcttttgatcgacgtcccctgtcgagaaaacatcaagatgaacaatatcgcttatctcattaagaatatccctcatttcattccgctgctcttgcatgatggcttttgatttattcttcgcatgaatcaactcatgttctaaaaacgattcttccacaaacgaatcggctagtcccgcatcagttacttttcctgagatactgttaagaaaagcaatcttcatatcgatcagatcaagccagctgtctgtaacaccagcgtgatcttggaagaatgctttgatgttatcagcacctttacctgaaaactcgctgtcatctaaatcagccattccctgaaaagctttcctgagattgataaattgttctctaacctgatcatattcttttgcccgcttttccgctgctgaaatgaacgaggatgcttcaaatactttcatttacgtctcctttctgcttctttctgtctaaattttaccatagctttatcatttgattaacagaaaaagacagtccgttccgactgtcatacacagttttatctcgtcctgtaataattttcagctgtatagtatttccagtcccaaaagcatccccgttcgacataatatatcggtctaaaaatatttcaaagtttaaatttaatggattatattctgaaccactttcaaatataaatagataattaggatcacctagattcactctatccttgtcgatcattaaatgacattcttccaacaggtagccaacaggtattccattgataccttcaaacaaaagctcgtattttagttcttcttctatttcttcaaggctaaatagatgaagtcctcctccaatattctcaccctctgaaagaatttcgaaaattttcgcaccattatgctgagaactaaacttcaggtaatcatcaggaagagtgaatttatgattcgactgaaagttttggatttcactaagagacgctttgtttggagaaaaagtcacaaggctctctacaatacatccctcagaacaaaacaatttaatagcccctttttcatctaaaagacttttcaaaccactgatagtcttatggacaaagttagtcaataaaaacacccccatactcctcagaataattactgaggatacgaatttgttaatcagtaacaattttattcataattgaagcagcacttgtggtgaacaaaatgtaagtgttatttgctgttttaattactatcctatccgtagagccagtttgaagtcctctgaggcttcttttttatttggtacattcaatctaaacaaaaaaccacagagcgtgtgagggactctgtggcctatagtggctgattaaacccctatgatacatcaattaggattttatcaaaacttttcttttaaagataacatcatctctgtctcaaataatgcctgcagcagctcatctatattaatttctttctgcttgtaattattcttttcataagtacgaataatttcttcatattctgatcgattatctcctttaatggagctaattccaagctcttcaccgtatcggttaatgaatagttgtttattcatttctttcgctttatcattttcataattacaaaatgcacctgacaactggacgagaaaagtttcatcttcagaatttaggttattctcgtattcaatgtcagacagaatattgtacgaatacttctgtttttacagtaaatacaataaagaggaggtgctgtttttttggagttaaaaaacatcgttcattcttacaacattacaaatattttgggttatctcagacgctctcgtcaggatatggagcgggaaaaaagaacaggcgaagatacgctaacagaacaaaatgaactcatgaataaaatactgaagtcgattgaaatcccctatgaattaaaaatggaaatcggatctggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagtaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttcaggactagcgccttatggataccggttaaacaaaaaaacatccaaactagtcccagtcgaagaaaaagcaaaagtcgttcaattcatctttaacatctttttaaatgggttgaatggaaaagaagttagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaagaacaaaagacggcaaacgaacaattagacctgaaaaggaacaaattgtagtatcggatgcacatgcccctataatagatcaagaacaatttcaacaatcacaagagaaaattgcaaacaaaatccccctgctgcctaataaaaacgcattggaattaagtgaattggcaggcgtatgcacttgttctaagtgcggtgaaccattatctaaatacgaaactagacgaacgcgagaaaacaaaaacggcacggaaagtgtgtatcacgttaaatcacttacttgcaaaaagaataaatgcacttatgtgagatataacgatgttgaaaatgccattctggattacctctcttctttaagcaacttagataataagactttaacaaaacatatcatatcaatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagagctccagattgccaagcatgaactcaatggaactcaagaagcgcaatcagaaatagacagtaatacagtcagaaacaacataaataagataattgatcaatatcacattgaaacaagcacagaaaaaaagaactcgctattaagaatggtcttcaaagaagttatcgttacgatgacacaaaaaagaaaagggccaattccggctcagtttgaaatcacccctatcctgaggtttaatttttcgctttcgatctcaccgtcactggtagtccctcacaatacagtaaatatctcaaaaaaccgataaagccgtttccccggtaaacacaatgggagctacgaagctgttgtccgagaagctgtttcatcaggcgaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgatcgatgacgccgcaacgctcaccctgcaatctgcggcgattacaaagggcggagaaacgtttatttttaaaatggagtccctgaggcttgaagaactgcttcacgggtttgaagaatatgcgttccggcacggactgccgcggccagccgctgttgaagtgggaaaacgtcccggtgagaagcttcatgaagaactgacctctcctcatgagacggaatctttatatgaatggggcaatctttacgcgatattgccggaccccgccaaacatccggaatttcggaaggtcaatctccccagatatcaatccgatcaggcgccgctcatcacaaaagacacaatcgtaaagattattgaacgattacatgaagaaaaaaaaacatagaaaaaaggcctgtctgataggcaggcctcattgctgagctctattttccaaataaatgcaggcaggcttcatagccctcttccttcagcttgtctttcggaataaaccggagtgccgcagagttgatgcaataacggagaccgcttggccccgggccgtcattaaatacgtggcctaagtgggagtccgctgttttgcttctcacttccgtccggatcattccgtggcttgtgtccagtttttcgtcaacctcttcttcctcaatcggttttgtaaaactgggccagccgcaatgagaatcgaatttatccagagatgtaaacaagggctttcctgatacgatatcaacatacagcccctcttctttgtgatcccagaattcattttgaaacggcggctccgttccgttattttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttctgcaagctgtttttttgaggcttcagcgatttgtttttgttcatcattatggtaatatatcgccgcccgatatgaacttccgcggtctgcaaactggccgcctgcatcagtcgggtcgatctgctgccaaaacagctcgacaagcttttcatacggataaatgtcaggttgaaatgtgatttgaacagcttctctgtgtccggtcgtttcactgcacacttcttcgtaagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctctcaggagaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaatttgcccccattcttgaggtctccgcaagccacattaccgcagtgaccgatgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcaacgttaatcaaactgttcagcaagctagacaaaaaacgctgacacaaaaaaacacaaatccctgaaaggatctgtgttttttttatgaaaacttattgtttcggatgataataggaaaattcaatttcatccgtgtcgagattgattttatccgcttttacatacatgccgttgtctaaaggcatttctgacagacggatctcgatgcttttatccccggaatgaacgtgcacaaatgacgggagttcataaaagctgtccatataattcagcacaaagctgattggcaggcttaattcacctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgttctcccggcataaccaataatgtcacaattaccgcggcggcaatcacattgagtgcgagaagaacaaaaaacagcgatttccattttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtgaggatctttttccagctcttttgcggcgatcttgttccaatccgtcacaaccccattaatttcttttaattcaggcagcgtaaacgtgaatggattatacatgctgacatacaccagctctgcgttttcattatatttgcggatttttgaaatgatcgtcttgaaccgtttttcaaaaggtttctcttccttttggaacggctgaaccgtcagctgcatcatattctggcggagcaccttcattaagtcattgccgccgatggtaaaaaagatatagtcggcgctccttaatgatttctgcacttttttattatcaagctttttcagcaggtctgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgacaggatatcatcatacggaaccttctgcacgccgtcataatctttaagcaccttgccgtcaggtccgactaaataaaaagaagtttgatgtatgacctggtcctctccctccggctttttgacgattgctttaaagctgttcatcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgccttggttctgatatgaaaacggctcaatctgatagttcagcgggtcttttatcgttttccccccgcaggcgcacaagagcagcaaacaaaagacggcagcgaagcttttcatttttttcatttccattccccccatagataaaacgcttacagcgttcatcataaaaaaattcccgcaccctcccttatcaaaaggaaggcgctaaggaatgtgcaccgttatgcgttatgttttaaaatctcttggctgaaaacagcctcataatctttccacttcatacggcgcttgacatattgtcggaatgaatacactgttcccacactttgtgaagcaaaaacttctttcaaataaagctcaaggtgctgatgaatttgaaaaaaatattgttcaccttccgtgacaaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatggcgcattgattatataattcaagaatcgtactgcacacttttccttccgggacaagcaaaacgtcatcgacgacggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgagcccggacaggagtcctcctccccctacgcttgcaaaaagaaaatgcggttcgacgtcaatgtcatttaaaatttcgatggcagccgttccctgtccggctatgacatcgggatcgtcaaacggatgaataaacgtgcggttttctttttcacagcattccgcagaactcttatacgcatcatcgaaagtgtcacccgtcaatatgatttcaacaaattcttttccgaacagttccacttgggatactttctgtctcggtgtggttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgaccacctgcaggtcttctcttttcaaatagatattgcagccatacctctcagaaagtctgtcattcctctgcaaaggcgtatgtatcacaacgtcctttacgttttggtgcgcttttaaaatgtcttttacctggatgagagagtcttctttaagcaacggtttcatttacagagtcctttcttatttaaatccctatttaatatgccattataacatgaatattcaaacaataagataattattttaattttgtaaataaaaataaatgaaccgatacaagagaaaaagatattttcgatcgcataaacgtgttatacttaaaccaattagaaccaaaaggagccaatttatgagtgtaattgaacaaactgatcctttttatcagctagccggcgaacatcacaccttttcagaagcgaaacgattggcctcgcaatttgccttatctgatttgccggtcttcataacgggtgaagtcggaaccggaaaaaaacaaatggccagagcgatccatcataaatcccgcagaaacagcgaactatttattaccgttcactgcagtcaaagcgaagagcggctcgaatatgaactgttcggcgctgaaggcgcattaaacagggcccgccgcggaacattattcttatatgaaatcggagacatgccgttctcggtacaggcccgccttctttccgagctggacgccgggctttccgcccgcatcattgcaagcagcacggcgaatcttggcgataccggcgcggaaaacacgttcagcatagatttattttacaggcttcacgtgttatgccttccgctccctgctttatctgaacgaaaaagcgatataccgcttcttctgcagcatatgctgacagcctcggggcagcatgttcatatcgatccgtccgtttatccgctgtttgagcggcacacctttaacggcaacatcagagaacttgaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaaaggcgaacccgccagcagacggagcatatccgaattaagcgaaaacagcacaatgacattaacgccccagcaagtcagaaacaggcttgattacttagaaaagatgaactatgtgacaaaaggccggggacgcgcaggaacaaaaatcacattagaagggttgacctttttgcagtcactgcaaaaacaaatcctttaaaaaggaggacatttgattgttcacaataaaagaagaaatcgcaaatgccgtcacacacggaatcggtgtattgctgtcgattccggcgcttatttttctcattatctttgcggtgaaatacggctcgccgacagacatcgtcagcttttccattttcggcgcttcaatgctcctgctgtatctcagctcgactcttttgcacagcatccagcataaaaaaacgaaagacattcttgaaattgtggatcattccgcgatatacgtattaatagccggaacatatacgccatttttattaggaccccttaaaggggcgctcggtctgacccttttaattattgtttggtcgcttgccatcggaggcatcgtgtttaaaatctttttcgtgaagcggtttatcattttttcaacgcttgtctatttaatgatgggctggctgatcatcatcgccattaaaccgctgtacgcttcgctgtcaggccccggtttcggccttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatatcagccggtttcagccgtttcaataacctgccccgcagcagccggtctgttcccgaagtgctgacgggcacaatcgggagatcgaaacgaagggccagttcctccggattgattttgccgtcttcggacagaatcagactttgccctttttgcagccggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcaagcagcagaagatcagccgggcgcaatctgggatgcacatacaatacggggccgtccggtatcggctgatcatgatgaatgccgattgccgatcccgacacgtcaatgcagcctctcataaaggctttcggccgctcatacaccagcctcatctgtttttgaaaagagagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaagggtttttttcatcttttactccctgtttgcgggaggtcaattcccattcagcttcattaaattccggaaaaaaacggtctccttcaaagacatggtgaatttttgtcatgtagagtctgtccgcatagggaaagagcgcactgtacagctgggcgccgccgattacaaagcattcttcatccgccgggatcagcttgagcacttcctcagccgagtcggcggtaatacagcccgggaataaagattcgtcccgtgaggttacaacgatgttccgccggttcggaagcgggcgtccgattgattcaaacgttttccgccccattacaatggtgtgacccgtcgtcacttttttgaaatatgcgagatcatcgggaaggtgccaaggcagatcgttatcttttccgatcagccggttttcatccatcgcaaaaataaacgaaatcatacgctgacagctccttttatgtgcggatgcgggtcataatcctcaatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagtcccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcagggcggaagcgccatatgatcaatttcgccgacattccaggcgctgacgattaaacgtctggaattcgggtttgtcttgatgtcatgaatcagccgggagatttgatcaatggtctcgccgtccgctccgcgccacgaacgccattgagagccgtaaaccggtccgagttctccgttttcatccgcccattcgttccagatgcggactccgttttcctgaaggtagcggacgttcgtatctccttttaaaaaccaaagcagctcatgcgcgatggacttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcagtttttccggccgacggtttactggaaataaccacatcctgatacgcttcatcatcttgaaacttggctaaatgtcctgtgatgacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccgtcagggcgtgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcgcggcgtcatgtccggcaccgtattatcatgcaatatgggaaattggtaactgtgaccgagtggataaaccgcttacaataagaaggagaaaaaggaggggatgagatgattaacgctttatttgcgactgtatcacttctcacgctgctttattttgtcgttatggaaatcactgattaacgaaaaagaagcccatgatatcatgagcttacatggatgacaccgaagtggaaaagcgccgtctttcttttcagcaccttgaagccgtatcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatctaccgatgaatcaggaagctcccgcaaataatcggcgcagtcggcatgtttaacctgaatgcgtttcatggcggtttggagctgctccattccggtttcccacgtttgaagtcctgtttctacaagcaatgagacaagcttgtttttctccaggccgatgacttgtccgctttttccgactgccaggcttgccaaaatcgcatcggatgccaggccgagcgtacaatctaaaaaggaatccccctcgcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgatgactaaaagatcgctagcggctcgttccagcattttttcaatgggctgtttattgcggctgcagtaagtgtcacccagcctgacactgagtgactgcgctgtgtgtatcgtgtattcgcttggtctgtaactcgttgtgatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagcgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcgagaccggctgcacagccgcacacggagttgacaacgactaatgtcgtgccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaaatccttatatgaagtcaaggatactatagagggggccggaattcaattgttcaggcctctgttttatattttcatgattccgcctgtattggcgcttgttacgagtttggaataccgggccagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccattccgacaatctgagacgtcggagcaagcatctccggcatgcccggtccgccctttggcccttcataacggataatgacaacatctccttcttttactttgcggtttataatgccttcaagcgcggcatcctgggaatcaaagacgacagcggggccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctccgagtgtgcggcctgttacagtcagcgcgtcaagatgaagcgccccttcttttttcgccaattcattaagggccgccgagactcctcccgcttcgtgcagatcttcaatgaagacgtccgaggccggcgccaatttcgataagtgaggcacccgttcagccacttcgttaatgcgttctaaagagtactcaaccccagcttcattggcaagcgcaagcgtatgtagcactgtgttggttgagccgccgagagccatgtctaacgcaaaggcgttgtcaatcgctttttcggtgacaatatcgcgcggcttaacgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcgggcagccgaactgttccagctcctgcaggtcgctttcaccgattttcccggcttgatatgcgccgacgccttcaaatactgaagaaagcgaaattttgcggccgtcgcttgtgcggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagtgaatatctcatgccgatatgccccatcgcgattccgtcatctactccgatcgtgttaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatccccctactgtttttagactgcgcaatatttttaaaattttcagtttattctagggcgcgttctgcaaattacctgtttacagcgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttatcactgttctttttttctgctttcagtcatctgtttccagactgaacctttcgcctcttctccgtgctcaatccgttcaatcgccattttgacttgcaggctgacttcgaattccggatcgtcttccgccgcttttaatgcttccagcgcgctttcatcgccgacttcatataaaaacatggccgcgcgccagcgcacgagcttgcttgagtcactgagcgatttcatcatagccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttccaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacaccctttactccttcaatgtttaaaatatcacgtacgacggccggagcatcatctgcctgatcaggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaacccgcccccgcttttgtattcattaagcctttaagcttgattaatttatcctctatatgggccagcacacttgtttgagttccgtacatcgggtgacccttcgcgccggcaaacataaaagccctgccgatgcccgctgcgccgatcgcatcaagcatgtctgcatcctgaacaactttcccctccaatgaaagcggccgctttatcagcagttccctgtgtctgaatgacattctcgtgatgatatccgcgatctcctcaatggagccagccgcaatgttgaaagcagccagccgttctgtcacttcgcctgccgtcagcctttcgcttttttcgagcttggcgtcaatcagatcatgaaccagcgcggccgtctcagtgataaataagtcggcgccttcttcttttgccatataaacagaaagtgttgcgacccgggaaatatgaagccagtcatggcccgtacgttcattgataagcttttctctgacccaattcctgacgctttccagctgctctttttcgttcaccgtatcacctcttatcgggccaaaagcctctgcaccgtatcttcaagctcttttgggttgacgttcggtgaaaaacgcccgttgacttcaccgtttcggtccacgataaacttagtgaaattccatttgaccgcttttgtgccgagcatccccttcgcctgttccgtcagatatttgaagagaggatgagcgtctgccccattgacatcaactttcgcaaacatcgggaatgtgactccgtagtttttcacacagaactcttgaatttccgcttcgtttccaggttcttggttcatgaattggttgcagggaaatcccaatatttcaagaccttcctcccaatatgtatcatagagctcctgaagctgcttgagctgggatgtaaacccgcatttgcttgctgtattcacaatgatcatcaccttgcctctgtaagccgatagcgtcatgtcttcgcctgttatggtccgtacgtttatatcgtaaattgtcatctgcggccctcctttttacattcttcatttattttacctgttttacactgcaaaacaaacggtaaccgctttttccttccacttaacggaaaacgtatttttcgaggaaccaaacggctctttacccgtcataataaaagagccgctccgaatttatacccatttgccgcttttatccctgtcattatgcgttaaatgcggtttattacgccgggatggattgaaaaatggcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgttcttaattccgagcacacatactccaaaaaatacggcaaggcagcatctggatgaattttatacggatttttccagcatccgccacaaacggtttgacggaatgattattaccggggctccgattgagcacctgccgtttgaggatgtttcttactgggaagaattgaaggaaatcatggaatggagcaaaacgaacgtcacttcaacactccatatctgctggggcgctcaagccggtttatactatcactatggcattgagaaagtggagctgccgaaaaaaatcttcggtgtgtttgagcataccgttcttaaaaaacatgagagattggtaagaggatttgacgagctatactatgtgccacactcacggcatacagatattaatacggagcagctgcaatcggcttcggatctggatgtgctcagcgtttcagaggaagcgggggtctgtttaatcgtttcaaaagacgaaaaacagattttcttaacgggtcatccggaatatgataccgatacgctgcttcaggagtatgagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaactccgtatgaatgggattaatttttgttttaagtgatacggtgacaaaaatatgataaaatactcttgattcagtatgcgtataacaaaactttaaaataatggaacatatcaattaaatttagtttaaatatgttggcgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatcccgacgttcaacgttatgaccgatttctgccttcacaaaatctgggttcatgaaaatgttgataaatattatgtcgccacagattacgtaaaggaaaaactgattgaaatcggcactcacccgaacaacgtaaagatcacaggcattcccatcaggcctcaattcgaggaatcgatgccgaaagagccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggttatgtagaaagaattgacgagctgttccgtattacggactgcatgatcacaaaaccaggcggcatcacactgacggaagcgacggcgatcggcgtacccgttattttgtacaaaccggttcccggacaggaaaaggaaaacgccattttctttgaagatcgcggtgcggctgtcgtggtcaaccgccacgaagaaattttagagtctgtcacctcccttcttgcggatgaggagaagctgaaccggatgaagagcaatattaaaagccttcacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttgcagcgctgctcgatttcttcaatttgtttctccattgacggcattccttttttcgccatttccgctaaacttcccaaatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaaatctccaaactatttgcggaggtgttttttaatggactctgaattttttccaaacggactgacggataaacgccagcttgaattagcggtggaaacggcccagaaaacaacgggagcggctacccggggccaaaattcaactttggtggaatctgcttaccaggcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatgcagaaagaatgagcgtgcgtttttccaaactctttgcggaaatgcttttttacgaaacagtctttgcaatattcatcctgaagctctgtcaattctttataaatgctttttttatccaatatcagtcatctccgttaccttctaatgttatgcggctttcaatctgccggtccgagagaatttttctggcaaggtcatccgcttcttgattttcctttcggtttacggcttcatatgtcggtgtcagctttaaggattcgaacagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtccggcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgtcttttatataaggaaagcggctgacttctcttgcaagcatgcgcgctttcggaacggtcagccaatcttcggaaaaaaacgcgacagggcctgttccttttgcttctatttcgatatacggcttaagattcattgaaatcaccttaccattcattagttgacgggcgtgtgctataatcaaaccattcttaaattgaaaggaagtcagcaggttttgtttaacgatgtgttatggatcttatttgcggtcattcattttatcattgttcttctgttttataaaggatttggcaaaacgggcctattcgtatggatcggtttcgccacggtgtgcgccaacttgcaggttgtcaaaacagttgagctgttcgggcttacggcgacactgggaaatatcatgtacggcaccgttttcttcgcaacggatgtgctgaacgaaaaatacggtccccgggaagcgcgcaaagccgtctggctcggcttttccactttgctcgctttgacatgcgccatgcagggggctcttttatataaaccggctgcgtcagatatcgcgcagcctgcccttgagacgattttcggttttctgccgcgtgttgcactcggaagcctcttggcttttattttcagccaaacgatagatgtttatgtatattcagccattcggagaatctttccttcagacaggcttctctggctcagaaacagcggaagcacggcgctcagccagctgctggatacatttatcttcactgccgtggcctttatcggcgtttattccgcgggcgtatggttcagcatctttatttcgacttacctgattaaatttgcggtatcactcatttctgtcccttatgcgtatgcggcaaaacgaatgacaccgaagggagagtgacggatgatgcctgctgaaatttacgtggacggtgcaagcgccggaaacccgggcccctccggtatcggtatttttattaaacatgacgggaaaacagaatctttctcaattccgatcggcgaccattcaaatcaggaagctgagtttctcgctttaattgaaggaatgaagctgtgtgccgcccgcggatttgagtccgtgtcattccggacggattcagatatcgtggagcgggccgcggaacttgaagcggttaaaaacaaggctttccagccgtttgtggatgaaatcatccgcttaaaggccggatttccattgtttttcattaagtggattcccggcagacaaaaccaaacagccgatcagctcgcaaaaaaagcggtccggctgaataaataaccggaatgaaattgcgtttcactgttcatcctacaaatgaggtgaacagctatgagaaaagaaaataaaggccggctgaccgggggcgtggatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaatcgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaacccccgtttcttctctgaatatctcatctgtatataccttataattgccgatacccttttgcagcagcgctacctgaacttgatgattcagcaattgaagcagatctttgtcgcccgttacaatcgtaatttccgcttctccggaaaatagggcagaaagcgtaccgatacagtcatccgcctcatagccttttatgccgatgtttaaaaaaccgagctctcgcgctgcttctttcgctaaatcaaattgcggaatcagctcaagcggcggttcgcttctgttggccttataatcttgaaacaaatcattgcggtacgttttgcttcccatatcccagcagcagacgacatgtgtgggctgaaacgtatcaaccgccgtaatgagatgctttaaaaaaccgttgacgccgtttgtcgggattccgttttcatttatcataaaattgcgatgaacggccgtcgcgaaaaatgagcggaacaaaagcgccatgccgtccacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataagaatcaaatttctgtccgaaaccgtttttctttttggcattgttattctgctgagcatttctgtttcccagttttgttctgcccattgtcatatccccccttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtaatgccattgatggcatctgtcgtgaacggttcattctgtctgcattttacaatggcttcttcaatggcctgttcacgctggtagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcttcgtaaaggtgttcaatttcccttgcactcgtattttccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttctgtcactttttgcaggctgagcctgagcccttctacaaacgctgcttttccgttctgttcaaaaaactgcttcggcgatttaacttcttttatgtgatgtgtgaatgccgagacgtcaatgaccggagcgacttctttcagctgaacggcaaattcgttttcggcgctcacataaatggagaaatctccgtcttccataagcttcttctgacagttttccatccattcctcagtcatatggcgctcaataaaaccggtcatccggatatcgagcgttttcagctcttgaatatattcaaaacggaattccttgagcgcttcattcagcgccgctgctatattttgtttccaatcgccgttttgaaggcccggatggaaggcggttttcagcatatcattcgcataaaatgtcaggcgatgtttaatgtgatagagctgttcttccgtatctttcatcacctttcgaatgatgacctcagacgtacggcgctttgaaatgtcagcgagagctttttcataggaagactccagacgctgtttctttttctctttttctcctgccgactggtgaagagattcgtgaagctgttccaccatatcgcacaatttgtccgcctctgttttcagctgggcgcagctggccctcattacatcttcctcaataaagtgctcaagtccggttcttacatcagagaacctgttataaaaagctgcttttttacccgcaagctcttctttacttgagacatgatataatttcggccggttaattccctcttttgagagttctgagcggacatagtctttgactgtttccagctcgctttcggttttggccagatcggcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaattgtgatgcctttttgcgtgagaggcgaatcataatacacggtgacttcttttacgcagcaggccgttttttcttcggctgcatacggttttaaatcttccaccggcaccgtcagtgtctgcctttgacggatctgttcttcatacgtatcaaacgcctgcagcatcgtctgaatcaccgggataagttcatccggaactttcccctttttaatggcataattccatctctctttcagtgaacgcccctttacatcagcgtctttcagctcagtcagctgaagcatttcagcgtccagatcctcctctgtcttaaaaacgatctccgcagatttatgcggtttgccggcttgcggtttcgttattttgttgatcgtagccgttgtgggcgtcggtgatgacggaagcacgtattcaccgacaagcgcatttgcaaatgatgatttaccggaactgaatccgccgaataacgccaaggtaaactggcggttttcaagccgctcaatcctgcttcgaaaggcttctgcctgttttcctaatatgctcgaggattcaagaatcccggcaagctcatagaaccgatcagtctgctcttttataggaagttccttcatcgcatttttttcgggtttgtttacttcatactgtacattctcttttggtttctctttttgaacgggcgcttttgcaaggcgtttttttcgcgtataccagtcgccgcttcccgtatcacaggtcaattcttcttcccacaaagcgcggacccgggctgctttttccaaggcattgcgttcttcttttgccgattgcgcgagctcatcccttatcttcttttctttttcgagccggtttttcaagttctcaatgagcggtccgttttttgcctgaacataagcggtaagctcctcaatgagttccgctgtctgtcttttggcttcccttctgatcatctcagcgaggtctttcgtataagttaatacgtattcagatgaaaaggccgctccctgcttaagggcctgagcggtgatatcatcagaaagcggtgtgcggtacgcctggattttcttgatcagttcgtccgaatccgcttcataccgcttggccgctttcgtaaatgtgtcgataatgtgccaatccgcttccccttccgttctttttttaatatcggcaaaaaattcagcatgccttctctctttctcctgagccgttttcgcttttgaaaagaataatccggttttaaatgagggctgctgtgattcaatataagcagatgcaagctccctcatctcaaagggtgtcaaattagcgttttgcaatatgttctgcacgtcttttctgatgtctttctctgctgtttcagcctgttgaacggctttattaagctcatcttcaacagaacggacaagtgcttcttgtttgtcaaactgctctccgcttccgtttttatcatcttttacgagcatctctgtatgctctttgactaagtgtgcgacttttctctccgttaaggaccataaatttgtttttgcctgctgtttcagcttctgcagatgttttttcagctgttccatgccgtttaaaggatggtcaggctcagtgacagacgtaaagaaaagcgattctttctgtattcccgcgccttcaagcatatcttccacctgcctgcggtactcttcaaacttcgtttcggtttcatcatgcctgtcaatttggttgacgatcagaaacaaattcggaatacggtctttgatggagctgagaaacagcatattttcttctgaatgaacgtgattataatgaacgacgtaaaataaagcgtcagcctggtggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttctgcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggccgcgagctgatcggcccgtttttcatcctggtgatccaataattgtacgtataaggcacccgttctgctgaaaatctccctgttatggcgttcttcttctgtcatgtgtcttaacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatcctcacagtgagcatgcaggcattgagaatcgaaaagagaaacagtgtccaatacgctccgtataacagcggcagaaaaataaattctaagatgacgaccgcgtagttcgggtgcttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagggataatgtccttctccgtattcgactgcgccttgctttttcaccttctgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacatgaaaaatagttgcggaagacatgttcccgtgtttttgcagcaccttccgagatgcctcaagctgaccggtgtccattgaaagactcgttaaataggcgtcaatgacctttttcccgcctggatgggcaagaaaggttttaatgtcgtgaggaccgacaccatattctattaaaaattcatcaacattgtccttcagccactgtgaaaccagggtgggaatatctcttgaaaaaatgacttgaaaaccgctgtcggtgaattcccagcccatcacatcttccgcatccggcatcatcaccgattgagtggcgaatatccgcggaagaagcggctgtttgacgccgtttcggttcgccttttctcctccgactagtactgcggcaatgccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccagatcggtatccgttttgttttcgcagaaaacggcagctgattcatcactttcgcttcaatgctgggtgtcgaaagcccggtgctggaaataaaaaagatcgcatccactttttcataaggaaagggatttgttaaacaatccgggtttgttaaacaatcaagcgccgcatccgcactgtgcttaacggtttcttccgtatacagccggttcttttctgaaaaaccccgcgccgttttataccattcaatcggccggacaaactgccttgattcaatttcgccgttttgaaaggcttttaacagccggtcaatatccttaaatgaatcggcaaacatccctctcgcaaaatccgccgccgtttcttgcgagacatgatattccggaatgctcgttccgaccgataacacatatgccatgcccatcacctcttcacataaaggtttccgcttttttcctgaatgtatgcaaaagattgaatcgaggatttcactgacatgccattttaatttaaaattggcccttttgaatgataaaccgttcgactatacttgatccattcataaaaaaaggttgtgataagaatgctgaagcccgtcattcttaaagggtcactcgttcagttagagccgatgacgattgatcacactcaggcactttgtgaagctgcttcagaaaatagggcgacttacgcttacacccatgttcctgacggaatcgaagaaacaaagcgttatattgaacgtgcgctttccgattatgaaaaaggacttgcattgccatttgcagtacggagtcttgaaaaagagcgaatcgtcggaagcacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgctgaaaaccgatgttcgcaaccagcgctcacgaactgcgattttgcggatcggtgcccaatttgaagggatccgccgcgcgcatattccggctgtcgacggcggcctcagagataccgcctactactccatccttcgggaggaatggccttatatccggcaaaacctttctggccggcttgcagcatataactgaaaaacctgccgatatatacggcaggttttttacatattcggatcatggacgtataaattgagatcgatccgtccgtctgacgtgaccgctacgccctcagcttcaagagacagcttctgtacagaaaacatctcttcatctcttaatccgatttcaccctttgcattgatgaccctgtgccaaggaagacgatgctttttactcatggagtgaagaatcctcacaacctgcctcgctccccgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcatctgcttcctgatcttatttttatagatgataattgcttcatcatcatacttattacatctctgcgtttaaatagattatctgtttgttcacaaaaaattaacaaagataggcatgtacatgtttaacataatatgtaataatacaattgtattaaaaagaaaaggagtgtttgcaatgaaaatgaaaaaagctttagccggctcagccctatctctcgctttactctgttctgccgcccctgcttttgccgcaggtcctgctgatacaccttctgcagaaagcaaaacgaaggaagtatctgttttggcgacgttcatacttaatggttctggccctgattatcctacttcaatttaccggaatggaatcacctattatttagacaacatcaccttccatggtgctgatggcacttggacagccgtctacaaaagctgatttttcatgacggcggaatgattgtcttaagtaacaactaaaaagctgctaatataagggggctttgcccctttttttagtttcactgccttttataattgatccagcatatagcacctaggtgcgtaatttcatttcacccgatgatcattatcagtcgtactgttttctgcttttagacgcaaaaacacataatctaaaattctctcccgcgtgtctatccaaaagccgagtctcaactctatcaatccggaacattttatcgacgcctgagttccccagctaacgttaagaaacctcttacttgctcttttatttttgataaaacaccatccagggtgataacatgagatttgcttgggaagaattaattataattgcattcggaatgattttactgagaatttcagggagaaaatccattgcacaaatgaccatcgcacagacaatggtgatgatttcaatcggtacgattatcgttcacctcattttagaaactagtttattgaaaacattaatcactgcgtctatccttttagtgctttaattttgatggaatggtttcaagtaaaagttaactggattgaattttttttaaccggaaaatctaaatttgttatagaagacggccaactcaatatagaaaacttaaagaagctgagactgacagcagatcaactcgaaatgcgtttaaggcttcttggcatttcaattaaatatgccactttagaagctaatggacaattaggctacgaattaaaagatgactgtaagcctttaaccatcaaagattttaaaaatgtgaccgacccaaaaagtcttaacaaagagcctcagccacaaaaagatgatcaagccaatctattcgaggaaatcaaaagacaccagactcagcacaagccaaaaaatcttgaataattcgctgattagtaaaaccttttgttattcaaaaccgaagccgaatcagaccgttaaccgtgccgatcattttttaccagcccgttttacaagaaacaaaaaagcatctgaagcagatgccttttttcagacgagatccttgtatgcgcctgaatatgcttttcagccgctatacccaccgccggccttagccataatgttaatcagtttgtttttataaaatcattgattaattgatcagtcgttaatattgtggcaaattcgtcacgcaatgtagccagagatatattgtgaatagtctcggcatcataatatgtatcattttggtctttcattccgaaggctgctgttgcatctgaaatgaggtaggtatcaaaccctaaattaccgctcattcttgtagttgttgaaacacaatggggcgtagtcaaaccagttattacgacagttgttatatcatttgattttaaaatctcttctagattagtcccgataaagctgctgtttactttcttggttataatgacctctttatccataggtttaacgatttcctttatagcaaccccctcattttttggataaaataaagaaccaggtttatcagaaatatgttgtatgtatatgactgtccatcctttttctctccataatttcagtattttactaatgttttcttccgcttttacgttatttcgttctccccattttttatcatcgaaagctttttgtacatccacaatgattaaagcttttttcttttctgccaccagataacctcctatattgaaaattagtatttataacattttaaataaagtttttacttttgtacaattgtttcagttttaaatttcatatcacacctttcccgttggaaaaacgctggaatagctaaagcaaacactcactcaaaggctgcagctcaccagaggccagcaataatcaactctttttctctatatacatatcagtatcctgaaataagcttcaacagcggatgaaaggattgccccctttgccatctactcccctaacaaaattcacgctgcgctcacaaaatattaacaaataatcccttggttatttttgcatttcatgtaataatacaagtgtatcaaaaaaacaaaggagtgtttaaaatgaaattgaaaaaagttttaactggttctgccttgtctctcgctttactcgtttccgcttcccctgcttttgcatccagccctggcaatacaaatagcgacttaactcaaacaaaaatttcgacacaagcgaccaaagattcttttacaatggattaccttcatagatgggatatcccaaatacaactgttaaaaatggtgttacttattaccttaagaaagtagaaataatcgaagggttctatcgcgcaacttttgaaggatggattaattagaagaaggggctttcccttcttttactctcttttgtaaggatcggtgcacaagacactccccctcagcgcccattctgcagttgcacttcggcatcgggcatttcattccatgtctcaaccaagtttcgtgtcatcacagtgcgagcaatgatattgtttacgatatgattccccatttttctttttttcttacattcagtcatatgttcacgtacatatagttcgggacggtttttcggcgaaataaggcggatgccgcatcactcaatttatttcttttcaaacaatgaaactaataaaaaaaagagaatgcctcacaaaaagttcagcaaactttcggaagcatcctcgatctggataaaataaggtgttattttaaagaaaacggttaactaaccctcttgaacccttgtcacatcaagggtttttttcgttttaggaatcatattataagccagtttctccggttgcgccagtaactcctgttgggccggttgagccagttacaccggttattcctgttgaccctgttacaccggtcgctccggtttctcctgttgaaccagttacacccgttgccccagtcactccggttgaaccggttgaaccagttgctcccgttactccagtcactccggttgagcccgtggttccggtcgctcctgttacaccagtcgagccggttgctccagttacccctgtcggaccagttactccgtttggaccggttacacccgtcgctcctcttgccccggttgcaccagttactcccgtcgctcctcttgcgccggtcactcctgtggggcctgtaattcctgttacgccagattcacccccggtttgcgccaatgaaacatcgtctattaaaaccgttccggaagaaactttacttaatacaatgacggcagaggccgcgccagaaggcacactgcttgttttatagatttcagaccatgtgtgaaagagcacgttcggcaaatttccgggtgtaatattttcttgaatggaactgatttgttcacctgctgcgctgacatagatgatctggagagtgacttggggacttggatcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccatcccgctaatgtgccggtttcaaagcttccgtttataatcggattattcattcaatctttttccctctccttcccgttgttgaccgtcttacttattaagacagcatattaatacgggctgtgttttgacaacctaaataaaaaaggtgatttcttttcatcaccttaatcagatccttgaatggggaatccagtcgcaatgagggagcggtttgctgctgcgacttgtgttacgtagttcgaagaaaggacggataaatagagctgatacgcggctgtttcatccgccttcatttcgtcgatgtacgtaaaaggaattcctatgatttgtccgcctgaagaaaagaggttccgctcttgtctctgtgtttgtatcgttacgccatttctttgcagctcgacagctaagaccaatgagaaatgagacgcaagcggatctaattccacatttacttgtatgacggcatccgttttcaccaattgatctgtcggcgcagctatcactgcgcttaacacgtttatcggtgttccttctaacggaagcgtcattaggtctgctgtattttgaaaagctaccgcaggaaccgctcccggcggcccctcaggccccgggggaccgggcggacccggcggacccgcctccccttgcggaccgcgggagccggcgggtcctcttttgccttccggacctcgcagcccgggtacgcacaaggcagatcgattttcatctgaagacggaaaccgtttttccgtccctgtttccggactttcaagttcacatggtaattgttcataccggcgtttcatatgtctgctcatatatttgtaaggtttctgtttcaatatcatgtattgattacggccgctgctcataatatcaccccggcaatattctattcgcactgaagtcatcgtgtgcaggcccttcccattccttacagaaataaaaaaaggcagacctgagtctgccttttttcttctaccataaccctaatactttccaccataatccgccgatcacaagccatgtcacaatatggacgattgacaggataaagccgatggaccaccatttgctttgcgagatataacccgctccgaaaaagaccggagccgctcctgagccgtaatgcgtcgtcgaaccgaaaaggttgctgaaaaacgccaggctgagcgccgccaacagcggcggagcgcctgccgccacgatgacggcgagaaatgccgcatacatggcgctgatatgcgcggttgcgctcgcaaagaagtaatgcgtgtaataatacacgacaatcagaatcataaatgccacaatccatgaaaaaccggaaacagatgatttcatcatattgctgaaccaagacaccatgccgagctcattcaggaaattcgccagcatcacaagcgccgcgaaccaagtcagcgtatcccatgcaccttgttcttttttgatgtcctcccatgttaatacctgtgacaaaagcaaaacggataatccgatcagggccgtcgtcgttgcgtcgatattgaagcttcctccgaaaatccacagcgcaagcaccaataaaaagacgataaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcgtgggccagcttggcgatcagcggattcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaacagcagtgaataagaaaggccgagtgttttcttcccgaaccgttgtacgaatacgtaagaaatcctggcgccaagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatccccctatcccattttactacttaactaagttaataaacgtttttgttaattaaaaaacacaaaggaatattttcctttgtgcttcttgtttattattttaatatacccgacccggctttagatataacatctgattttacatttgatgatgagccgatggaaccgtgcaatgacggtgtccagccgacggactgacttaatccgttggcagctgacgcgttaattgcggcgccgtttaaaagagtgccgtcttcatgaagcgcttttccgccgctgaagacgctgatgactttatcagcagccagtcccggcacttcaaagacattattctgggcatatatttttgacgcgtggcctgcgccccacgcatagctgaacgggtatgcggcgcttttagagcctgcgtaaaaattattataaatatgaacctgcccgtaccggacccgcggtgcgcgctggacgatgttctggtaatagttatggtgaatggtcaccttcagttttccttcatccgacgtcttgctgtcgctatttccgatgacggagcctttgtcatggtcatgatatttattataggacaatgtaatataattcgccccgttggctatatctgtctggccgtcatggtgctgatattttcttccgtaatagtagggaaaaccgctgtcgggattcgatccgtcattaaaggtgcaatgatcgatccagatatgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacgccgttctttatattaaagcttccgcctgtcactttggcatttgaacccgaaccgatgatcgtcgtatttgaaggaatgtcaatcacgacccgtgctttctggtttttttgagatcgctgtctggcgtcttcctgggtgcctgacggcgcttttttcccccatttgtccgggtcgtacgccttcagataagcgttgagatcatatgccggatctttataatcattaaagccgagcgttttattccggtcgtccgtattcatattgattgtgccttgtatgtaaataatcttcggcgtgctgttggcgcttccccctaatgcagaaacgagctgctgtctgtttgatacggtgtagacattcgatgaagaggctttcgcgccgccggttgtcccgccggaagcggctccccagccgtcatttgttcctaacgtctgccgtcccaggtcagcggcatagacgtccgcagggatcatacataaacaaaccgccagcataagtaacatttttttcatgaattgtgctcctcctgattctctgttccactttattacaattggattgtatcaaatcagttgagaaacggcaccgaaaatgtacagcatgtgcctttcggttttattgcggaaaccgcaaaaaaatcccaagggaccgaaaaccccttgggatctgttcagcttacgcccatgattttactttttcgttatccgtgacaaacagaagaacttttccttcatctaagcgcttttcaaattgtgatgcttcctcttctgaaaagccgatttcgtgaattttgttgcggagctcgtcgccttttttattaaacatattgccgaccgcgtgtttaatgcccgtttctttcgctccgatggtattgacatcagtattatccgccagacggtccgttctgtcgtcatcatgtgaaagcacatatacgtcttcttttgcgacacccaattgctgaagctcttttacgtcctgcatcagtttttgatcatttgtatattctcttactaccggtttcattgataagtcctcccttttgtttttgtatattggatgtttacccgctcaaccaaaggtcaaacaaaagaaagagagttccgggaaaaaacgggcagattgtcggtggatattttccggcgggacatgttacagtagggaaagtaacttttatcagaaaaataaaaatcttcatgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccgacagaaattgaaaataagctgggttcttatctgaccgcgcttcagcccgtgattacctctgacatgcttcattcttcaaaaacgaatgcctatgaatatttggaacatgagaaaaacaccgatgtgtaccggttattcttttaaatacgcatataagaaaagaagggccgtggcccttctttttttgttgccggcggacggtttgattttgtattcgggaaatggttcgtgttacatttggaacaaccacttatcttgaaggaggattcagtatgccgaataatcagcagcagattcaattggcaagacgcccgaaaggcgttcccgtccatgacgatttccgctttgaaacgattgccgttcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgctgaagttctgacagacggagataagctgaaaaaaggagatgttgtgatcggaaatctcgcatggcaggaatattcagccgtcaatgagtccgccctccgcaagttggatacggatatcgcacccgcccaggcgtatctcggcattttagggatgaccggactgaccgcttacttcggcctgctcgatatcggccgtccgaaaaagggcgaaaccgtcgtcgtttcaggggctgcgggcgccgtcggctcaacggtcgggcagattgcaaaaatcaaaggcgcgcgggttgtcggcatcgccggttctgacgaaaaaatcgcgtatctgaaagaggagcttcaatttgatgaagccattaattacaaaacggcggatgatattcaaaaagcgcttgaacaggcatgccctgacggcgtcgatgtctattttgacaatgtcggcggaccgatttcagatgcggtgataaacctgctgaatgaattcgcccgcattccggtatgcggagcgatctcttcatataataccgaaagtgaagaggaagacatgggcccccgcgtccagccgaagctgatcaaaacaaaagcgctgatgcaggggttcatcgtcagtgattatgctgaccgcttttccgaaggcgcgaaacaattggctgaatggctcaaggacgggaagcttcattatgaagaaacgattacggaaggattcagccatattccagacgcgttcctcggcctgtttaaaggaaaaaacaaaggcaaacagatcatcaaagtcagtgatctaggttaacatgatgatgaaaaaaaggagggctttgtcccctccttttctgctttttcgcatcagccgcgaagaatcaaagtaagaaagccgtcttcatcaggctccgtatctttcaaattgaatcccgctgcttgaaagcaggctaaactgatttgattgtcttttttcgatgcttgccgcccattcctacacgctggtaaacccaggatcagtcagcagtttttgcaagatctgttttccgtacccttgaagctggtacaaaggattgacgatcaatccgatatacgcccgttcctccacaaactctatagagactatacctgccggaagctgcccgtcatatgccataatgacagtatcgtcttcatctttattcaatcgtgcataccacgcgtctaatggcagcatcgcatccattctccgtctgatgttatcgttcttaaaccagtgttcgagtatttccaacccacgttccttcaatatttgaaatcggtctattgaacccatcttcccactcccccgcctgaaccttttctattatttcacaataaaaaagaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggccggatctgtggatatatccgtcttcattcgggatgtctgcgtgaatgacgtacggaagatcatcgatatcaagtccgcgcgccgctatgtcagtcgccagaagcagcggaaattctcccccttcaaacgctgataatatctttgcccgctccatttttttcgcttctccgtgcaggatgccgagatccacgtgatgataggcgagtttttccgcatagacgcttaaatttccgatatctctgacaaacacgagcgcctgcatgccgttcagccgtgacagcttttgcaaaagctttactttatcccgctgatcgcagacgagatattgatgcgtgacgcgcgctttttccgccgtattccgctccactttcaaaacggccggttcatgtgcgatggcattcagcacctcttctgtctccggctgcagcgtagcggaaaagcttagaagctgtcggtctttcagcgtcgttttaatgatttttttcatcgtttcgcggtgttcctttgtcacgagctgatccacttcatcaagaacgatcgtcttgacttcatgcattttcagctttttcgcctgaatcaattcgagcaccctgcccggtgtgcctgcaatgatatgcggtttatttttgagcttctccacctgctttttcacgtttgccccgccgattaaagacaaagcgcgaagatcggagccttttttccactcctgaatcacttgaaaaatctgcatcacaagctcgcgggacggcgctaaaatgatcacttgcggatgtttctgttccgggttgatccgctccagaaccggaagcgtgtacgccaatgtttttcccgttcccgtcggggattcggcaatgacgtctttcccttccatgatcacctgagcggctttttcctgaataacggtcggctcctgaaaacctgacgcctcccagttttcggcgataaatggttgtgtatgctgtaaaaatggccatgtttgggtcatgtcgttctcctcaattcttaagatctactccatagtatctcaaatgcacgcggcaaacgcaattttctttttccttccaagccttttaacaaacggtctcctcctttataatcataaatgagaaagacacatgataaaaaaagcgtgtctgataacgatagaggtgtaatgatgagtattttatccgtaaaagatttaagccacggcttcggtgaccgtgcgctttttaacaatgtatcgttccgtcttttaaaaggggaacacgtcggcttaatcggagcaaacggcgaaggtaaatcaacgtttatgaatattattaccggaaagcttgagcctgatgagggtaaggttgaatgggcgaaaaacgtgcgtgtcggctatctcgatcagcataccgtgcttgaaaaaggaaaaacgatccgcgacgtgctgaaggatgcgttccattacttatttgcgatggaagaagaaatgaacgagatttacaacaaaatgggcgaagcggaccctgatgagcttgagcagctgcttgaagatgtcggtgtcattcaggacgccctgacaaacaatgatttctacgtgattgacagcaaagttgaagaaatcgcccgcggcctcggcctgcaggaagtcggcctagaccgcgacgtcactgacttaagcggcggacagcggacgaaagtgctgctcgccaaactgcttttggaaaagccggaaatccttctgttggacgaaccgacgaactaccttgatgaacagcatattgaatggctgaaacgctatttgcaggaatatgaaaatgcgttcatcttaatttctcacgacattccgtttttaaacagcgtaatcaatttgatttatcatgtggaaaaccaagagctgacgcgttatgtcggtgattatcatcagtttatggaagtctacgaagtgaaaaaacagcagctcgaagccgcctacaaaaaacagcagcaggaagtggctgagctgaaagatttcgtcgcccgcaacaaagcccgcgtcagcacgagaaatatggcgatgtcccgtcagaaaaagcttgataagatggatatgatcgaactggcggccgaaaaaccgaaaccggaattccatttcaagcctgcgagaacgtcaggcaagctcatttttgaaacgaaggacttagtcatcggttacgatactccgctgtcacgcccgctcaatctcagaatggagcgcggacagaaagtcgccctgtacggcgcaaacggcatcgggaaaacgacgctgttaaaaagcctgctcggtgaaatccagccgctggaaggcacggtggagcgcggcgagcatcaatacacgggctatttcgagcaggaagtgaaagaaaccaataacaatacgtgcatcgaagaagtgtggagcgaatttccttcctttacccaatacgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcccgtgcggaagttcctttttttaatgtccggcttttattccggcaagatgtttgcgtcccataagaagaacaagcatgccgacaaaaacgacaatcccgcctactgtatatggtgtgcttgcggtgaagtgttctgacagcattcccgcaatccacggagcgagcgcaccgccgataaagcggactgagctgtaggctgaagacgcgattgaacgttcaaccggcgcagcacccatcacagcggttgtcatgatcgtattcaccataccgaggacagcaccggcaacaacgatacatgtaatgatcaacgtctgatggtcagtccagacccccataataacgagaatggccgcaaaggcgataaagagaacgacgagcgaacgcactgtgcccagcgctttgtgcacaagcggcgccgtaaagactgacgtaattgccagcagaaggccccagccgaagaagacatatccgagaccgtgttcatctaaatccagaacgaacggagaataagcaagcaaaataaaaaatccaaagttgtataggaatgcagatactgccattgtcaaaaggcctttatatttgagcgccttcatcgcatcaaacacaccgacgcgtttcgccggtttcggcagcttcggcagcatgagtgaaatcgcgcaaagcgctatgagcatgaggacagacactccgaagaacggagcgcgccatgaaatgctgccaagctctccgccggcaagcggcccgacggaaatccccagtccgagcgcggcctcatacagaataatggctttggcgctgccgccgacagataccccgacaatgacggcaagcgcggttgaaataaagagagcattcccaagcccccagccgccgcgatagccgacaagctgagcgattgaacttgagcttccgccgagagcggcaaacacgatgataaaaataagtccgagaagcagcgtccattttgcgccgatccggctggaaatcgcgccggagaaaaacatcataaaaccggtaacgagcaaataacttgtaaataacagagatacttcactaggtgaagcatgtaattgtgcggcgatcgccggaagaatcggatcgacaagaccgattcccataaaggaaatcacacaggcaaacgcaaccgcccaaacggctttcggctggctgaataagcctgttttctgttgtgatgatgtatccatttgaccagacctcctgtttcatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagttcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgtaaactttttgtgccggataaacttggcttggacggaacctttgtctttaaagcgccgggagacatctgtgtaagataaaaaaagccggtatgacccgccgtcttctcgggggccgtaccggcttttcttaattctcaagttcttcaatcatcagtgacaattcggtccagcgttccatcgccgcttcaagctcttcagccgtttttgcctgttcggccatcagttcttgtatctttccgaaatcacttcccgcttcagcgatttccgcttccagacgctgatgcttttcttcaaggccggcgattttgtcttcgatgccgtcccattcgatctgatccttgtacgaaagctttttgcgctttttcttcggctcttcttccgcctttttctcttcggccggctgttttaccgccgtcttcttcgcttttgcttgttccatgtattcactgtatgaaccttggaaacgggaaatgacaccgtgtccttcaaatacgatcaggcggtccacgacgcggtcaaggaaatagcggtcatgggatacggtgatgacgacgcccgggaactgttcgatataatcctcgagcacgcttaatgtttctgtgtccagatcattggtcggttcatctaaaaacagcacattcggctcctgcatcagtacattcagcaagtacagacggcgtttttccccgcctgacagctttctgatatatgtctgctgcatcggacgcgggaacagaaaacgctcaagcatttgttccgcggtgatgacatcgccttccgccgttttgacgatttcggccgtctcttttatatattcaatgactttcatatcgccgttcatttcgctgtgatcctgggtgtagtagccgatccggaccgtctgcccgatggtgatattgccgctgtcaggctgaattctgccggcgaggctgtttaaaagtgtcgttttcccgattccgttcggcccgatgatgccgattcgttccccagggatgacaagctcattaaactggctgatcagcgcttggccgttataggtaatggagacgttatcggcttcgattacttgttttccgagacggtgggaaccgatcgcgaaatcgagtgatccggagactgccggccctttttgctccttgagcgcctccgctctgtccactctcgctttttgtttcgtcgagcgcgctttcgctcctcttctgagccacgccaattcgcggcgcaggaggttttggcgttttgtttctttctgctctgccagcgcctcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcaggtgtttctggcgctggtcattttccggttcttcattcagcgcctgaagcgctttttcgtattctctcatcgttctcatgacggctgatccgccggaataaatatgttcaagaacggtttgtccggccggaagctcagggtcctgatgcaagaactcaatatgcacgtttcctgaagccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctggaataaaactagtaaaaggacagacaaatttcttggaagagatcattttgtccgaagaatgtttccgcctctccttttatacactggaggggaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgcggccgcccgtaattttgtgttttcgaaagcggaaatggattatattctgtggctggacgccgacgatatgctgacggaaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaggtatacggaaacatcatagaaaccgatattgccgtcacacaccggaaatccgagaaaaagcactcgcctccctcggaccgcaacttgaagatttatgagagaatggcggaaaacagtgaaacgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagggcgtgttttggtatgagctcgccctatccgccaaaagcagtgatgcaggctttacccagctcgaatattccacctggtacccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcgaaaaaaagagctgcccccgtatgaagggcagctcctttttgattacgctgtcggaattcctccgcttacactgtaaatttgggatgtcacataactcgattcttctgaggccaaaaagacataaatccctgccagctccgccggctgtccggcacgctgtaatggaacggccggtgtttccttgccgaatttcggaatgttttctccgggctgtcctcccgaaatctgcagcggtgtccagatcggccccggcgctaccgagttgactctgattcctttattcgccagctgctttcctaggccgacggtaaaaccgataatggcatgtttcgtcgcagcataatccaacagcatcgggcttggattatacccttctacggacgttgtcgtgataatagacgcgccttccggcagatacggaagcgcggctttgacgagccaatacagcgagaatacgttgacttcaaatgtttgatagatttgttctgtagtaagatcgctgatatcatccactgcctgctgtttgccggcgacaagagcgagcgtgtcaagaccgccaagctcttgatacgctttttccgccaattctccgcaaaacgcttcatcgcttaaatctcccggcagcagaacagcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagcttgtttcaccgcagtccggcacaggcttcatctctttctgcaaaccgggcggttcttgatattgttttggaaattcatcatgatcatatttcgtcagcgggttgtgcagatttgcatcagacatacaagactctcctttatcattggtgatgtattcgtatgtgtacccctttagcatgacggatcaaacgtgtaagtgcagtttccgattgataagggaaaacaaaaaaggagcccgtaagctccctttttttatgattctccgagcacgttttcagccattttcgctaaatgctgggcgcttcccgaaatctcctgcatcgtggcagaaatttgttctaccgccgccgcttggccgtccgtgttctggttgatggattcaattgagtcctccagccctttcagcaggctgtggatttttttcgtaatctggtcaatttggccgacattgtcttttgaatgagtggcaagcttgcggatctcatccgccaccacggaaaagcccttgccggattctcctgctctcgcggcttcaatggccgcattcaaaccgagcagattgctttgatccgagatgcccttgacagtaacggaaatgtcggcgatttctcccgcgctttcactgacttgtttcgcctgagcggaaatcccggtcatctgtgctgagaaaccgctgatggattctgagatatccgcgatcgccgaagcggtctgttccacgacggcggacaggctttcagcgacatcatgaagcttggctgatttttcaaggctcgtgccgagaccgacgccgccgatgacttttccgttttcatcatgaagcggaatcgctctggcgatcagcggaaatccgaacagctctttcggcaccatgcttgtcttcttctgattcatgcggatcgcgtctgtaatgatgtcccccttttgcagcggatctcccggctttacattaagagaaaacgttttagccggaatattcacgattaatttttctgtatcataaattccgatggtgatgtcatcttggatcaggctgtttaaaaaaggcgcaactttgacaaaagcgtcaagcaggctgtgcgtttgctgctccgtctgtatactcatttctttcactccttcttaatatgggaattggcgtttttcatgctgaaccgaaatccatttcagcgtggtgaattcttcaaggctccattcgccgttcagcctgccgagacctgattgtttctcgccgccgaacgcaacgttcggttcatcattaatggtcgtatcgttgacgtgaatcatgccggtttcgatccgcttagcaaactcaacgccccgctccacgtttgccgtatgcacggctccgcttaaaccgaacggtgtcgcgtttgcgatgcttaccgcttcatcctccgtttcaaacggcatgatgcagacggccggtccgaacagctcctccttcgcgatgctcatctcaggtttcacatcttttaaaatgacaggctcagcgaccgttccgctgaatcggccggacagcaccggaaccgctccctcttctatcgctttttcgacagaccgtctcaggccttccgcctgtctctcattgattaaaggaccgataaccgtatcagggtccatcggatcgccgactttcagcgatgacactttcgcttcgtagagctctgtaaatttgtcataaacagatgtgtgaacgagcacgcggttcgccgacatacagatctggccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgtggcacgggatgctcaacaaagctgtcgccgatctccccgatatccgtcacgatgacattcagcagcccgtccggtacgccggccgcttcaaaaattttcgcgataagcgttccgccgcagatcggcgtttcttcatgaggcttcagcacgacgccgttccccgcgccgagtgccggcgcaacagatttcatcgaaaggaaaaacgggaaattaaacgggctgattacccccgcgactccggcaggtattctgtacagcctgttttcttttccgtcaatcgtggacgggagaattttcccttccatccgcaccggaaatgttgcggcttcttttatcatatttttgacaagtccgatttcaaactcagccttcagccgtgttccgcctagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcaggcgtcgcttttcggaatgaggtgatgactttttgagtataaggatttctgttttccaatacgttccggctgctcccatccctccatcggccgccgataaactgcttatttagttcttcatattgaaacatgtaaacatctccctttcaccgaaacttgaaattagttgatgagtcatcttttgtatcggtcttaaggtgagaaaattgaactatttcacaataaaattccctttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgttactctcggggagtgtctcgcgtttttaatcggatgggacttaatgcttgaatatgttatcgcgctcgccgccgtcgcaaccggctggtcatcctatttccagtcgcttcttgcaggattcgggctgcatcttccggaggcgctgaccgccgcacccggcagcaaaacgggtgccgtgttcaacctgccggccgttatcattattttggtcattaccgcgattgtttcaaggggcgtgaaagaaagcacccgctttaacaatgtcattgtattgatgaaaattgcgatcattctgctgtttatcgtcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgcctgtcggaatcatcggcgcgcttgccatctgcaccgttctttacattacggtatcgctcgtcctgacaggaatgctttcgtacaccaagctgaatgtcggagatccggtatctttcgcgctccaatttgtcggccagaacaaaatagcaggcattatttccgtcggcgcgattatcgggattacaacggtcatgctcgctctgctttacgctcaggtgcgccttacatttgcgatgagcagagacggccttttgccccgcatgttttccaaggttcatccgcgttttaaaacaccgtttcaaaacacatgggtgacggggatcgctgccgccgggatcgcaggttttattgatctgggaaccttggcgcatctcgtcaatatgggaaccttggcggcctttacagtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtggtatatatgatgtattcgagaaaacacagtttgttaaataaataaaaagggaggctcttttttctgtttgagaaagaagagccttttttgcccttgataattcattcaccttatgaataatatggtgtatgcttcgtttacataaaaaggaggagaatcactttggcaattgccgccccgcttaaagaaaaacctgtccatcgtcccgagacaaccatgtattctattttgttcattatcgggatctgtcatctgctgaacgattcactgcaagcggtgattccggcgatgtttccgattttggaacgttccatgaatcttacatttacgcagctcggaattatcgcctttacgctgaatatggtgtcttccgtgatgcagcccgtcatcggctggtatacggataaacgcccgatgccgtatgctttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcttacatggccgccggcgaaaagcgcggattggcgcaatcgatttaccaagtcggagggaataccggccaggcgatggcgcccttgattaccgcgctgattctcgttccgctcggtcaattcggctctgtctggtttacgctagtcgccgcaatcgctgtgctgtttctcatttatatcgccaaatggtataaaggccgccttattcatttgcgcgccgcaagtaaaaaatcaccggccgccgctgtgcagaccgtgattacaaaaccgattattcttgcacttatcatgattatcttcttaattttcgcgcgctcctggtatgtgagcgcgatcggcaacttctatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcatcgtttccatgacggcatcggctcccttgacgattttccttccgtttgcgggacctgtcatcgcctatggcgtactggcgctgatcggcgttgttctgatgtccagcttctccgtgacggttgtctacgcgcaggagcttgttcccggcaaaatcggaacgatgtcagggcttacggtcgggctcgccttcggaatgggcgcgatcggagcggttgcgctcggagctcttattgattcagcgggattgacgccgaccatgacagccgtcgcctttctgcccgttttaggtctgctcgcctttgtcctgccgagcgacaaaacattaaaagaatggcattcataaaaaaatccctgccgaaaaggcagggattttatgtttcaaccgtataaaaatgagtgtcaggaaccgcatatttcggaataaacccgtctctgaaatcaggaaacgctttttgaatttcatcaatccatttttttacgtttttgatgtacgggacataaatcatactgactgtcgcctcatcatcaatgtgatagtaccagcagagattgaattcgttctccgtgacgagcgtaaagcctgaaaaatgataaaaaatcagcggggtgtcattgacatatacagccccgtcgcgcaggctgacgtcatattgctcaatattccacagcgccgcattcgcgccgatcgactccgtgacatgaacgtgttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacagctcgcccgcatctgcgaagaaaaagagatcggtgtccaaatgggcaaaatattcggcttcatcatactccgtcatcacatggaacagaaaagccggcttcagcgtccagcaatattcatgaaatgtccggccgccctttgcttcaagcagctccgggtcctccatttcatggagctgaaccgccgtgacatgttcccacggcacctgctgaagcagttcgtacgctttctgatcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagtcagcgctttgaacgcccttgcaaagtgcgtgacgcccagttttttttccgcttttgccaaaagctttccgacctccggcagctggaagctgttcgccgtgatacgcgggcttttcgtcttccagtccgggtcaaggttgcggtctttaaccgcgtgcagcagctcgagaaaaatgtgcagcaggctttcatatttctcataatcaagcagcacttcgatgtctgccattatgctgttggttaactccgcgtcaaacgggccgttaaacgcgaggtgcacgtcaagcgaatgaatgtcattgtacttgtcgcacatgtacgcgatattcgccctgatgtcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacaggccgagatctgccacgtgctgcctcttaactgatgaattgttcgtaatgaaaaaacgccatggcagacggtagccgttcaaatcatctccgtatttttccaaaatgcttttcagcacccggataaagtcggtatctaaatcaaagcatcgatcaagaaagcttccgtctctgatgtcactttcatcaaggagcggctctttatcgcccggcagctctttatacagttcggcgagtttttccttatgctctttttcaaaacggtcataataaaagctgtaaatccgcttccagaacataccgcatacgacaagatcgtcccggttctcatgagccttgatatgcttcgccaccaaatccttttcggcaagcatgtcgctgtcatggaaaatcaaaatatcgcctctggcattgcggaccgcctgattccggccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagcctctccttggaattatatgcgggaacaatgacgcttgccttcacttttcgttcacttcctgtatatgatcatttatttgttatcatcctcagatgcaaagccgctgaactccgggcagacggcgctgaccgtcccgatcacccgcttcagaatgtcctgataaagctgatggacaaaaggcaggtcggtccggtccgtctcatgaatctgccgaatgtcgccggctgtgacgatccggtatccgctgaaatgatagaaaatcagcggatttccgtcttcgagcacaagacgcccatccttccatgaaaacgtgtggcggccgtaattccaatggccgatattcacgccgggcgtggtgatgtcacacacgttcgggaacaggccggacatgtaatccaagtagccttgatctccgaattttccttcgcccggcgcatttttgcattcttcaaggcagcgttctttccaccatctgagacaatctgtgccggcactgtcggttttgaagctgagaaaaccggaattataccggcctaaaagacgctgcagcatgtcgatttcctgtttttcaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatccggacgcattgcctgcagcacgtcataggtgtcttgatccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccattcgatcgttttttctaatccttcatcaatggtatgcgcgggcgtccaattcagaagcttcctcgccttttccgctgataaatattggtgcttgatttcgtggcttccctggttaagcactttcggcttgaggtcactgtccatcgccttaagaattttttctacaagttccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaataaatcggcacagctttttgatacgtcatacggatgtttgccctgaagaggcatgttttcatcgtacggcagtgtcggctggtcgccgtacgctttatcactggacgcgacgatcacccgcttgatgagcggatgcctgcggcacgcttcaaggatgttccatgtgccgagaatattggcttcaaatgtggaaatcggattgcggtttgcgacgccgacgatcgcctgagcggctaaatgaaagaccgtgtcaatttcatactcgcccagcgcccgctcaatcacatccagatcttcaagcgcgccctgcacgatgttcatttgcttcacttgttctccctgatacaggttcgacttgggcacagtgtcacggacaagtcccgtcacattagccccctgatcgatcagttccttcaccaagcagcttcctaaaagacctgtacatcccgtcacaaacacatttttatttttccagaaactcaaacttgatcaccataccttccatacatgttgtccccggtcccacatcttgttaatttccagcagatttttatacgtatcgatcgccgtccagaaaccgtaatgccggtataccgccaattcgccgtcctttgccagctccttcagcggttcttcttcaaacatgacgtccctgtctttcggcagataatcaaataccttcgggctgagcacgaaaaatccgccgttgatgatgccgtcacttgagtttttttcagaaaagcttttcgccataccgtcttcaaccgtcagcgttccgaattgcgaggtcttttctataccggtgacggttgccgcagccccttttgattgatgatagctgatcagatgaaacaggttgatgttcgccagtccgtccccgtacgtcataagaaaggtttcatcaccgatgatgtccttcgcctgtaaaagccgccccgctgtctgcgtgtgttcccccgtgtctaaaaaagtgattttccacggctcggatgttcccaatatccgcacttctccggtagagctgtccagcgtcatgctgtgattcttccagtcataatctaagaaatattccttaatcatctctcctttgaaaccaagaagcaggataaattcgttcacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaaccaacccgataatttgtccgattctctaccaccggtttcaaaatctactgtaagatatgagagattggcgccctttgtgaccaaaagctctctcttttttcagattggtgaagatacacacaaaaaaagagcctcacggaaattccgtaaggctctttctattatttattatcctgattcagcttttctttgccgtaatgatatttagacggatcaaccggcgtaaagtcgctcaatttgtggaatctgagcaggtctttgtacatcacgctgtcagacagcttcagctgctctgtgactctggctttcaggtttttcgtttcctgattgcctttcagttctttccctgtcttcgtatcgtatacgacattggagatggaagtatatttcggcgtgacgtaatctccgttgcggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtaatggtctccgtaaagcataatcaccgagttgtcatataaaccggatgacttcagatctttaaagaactgttcaagcgcttcgtcaagataacgcgccgtctggaaatagtcatccacagtcgcgtcgcccgttttcgctttttcgatcgttgcgtctttttcatcaagcgtaaacggataatggttcgtcagcgtgagcaaatgcgcgtagaacggctgtttcagcgactgaagcttcggtatagattctttgaagaacggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtaacttctttcccgtcaagtttgtaattgatcaaaaatgattggaagctctccaggtgaatcttaatgatgttcttgcctttggccttgccgaaatactcggcgttcggcttcgcataatgcgacgatgtatagttttcaacgctcgtcaggtcatcactgctggcatatgcccgctgtgattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaacacaatacccgtcacgataattaatgacgtataccgttttttcagcttgaattccttcagctcacgtctccacaccagaagcgcgattaaaataataatatcaacaaagtataaaatatcatggccggacataatgctgaagatgccgtctcccatatttccgacattaccggattgctttaagttcgggaatgtcaagaaatcatcgaagaatcgatagaataggatattggcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccattttaaaaaacgatatatttatcattcgtgtcatgcctattgaacatcttatcccgccagccattagacgcaggatatccgttcttcgtttcacatttttttctggcattaaaaggtaccttatcagacccggtctgaaaataggagataccaaatataagaataacacaaacttctaaaaacgaaaaatgaatatcaaagacagccgcccaacaggcgggctgaagttattgtatgcaaagggactgaaaaacttgaaggttttttttgggtgatgtaaaaaaaggaccggagtcatccagtccttttcatcacatcgctcaaatccccgcccaaacatcttttgcgtaaatgccttttgtctggaggtccaaaagccattcttgcgcttgccgttcgtctgtttcgcggaccgactgatacgctttttgcagcgttgcctctacatcgggcgccattttgctgccgtctccgcatacgtagaggtgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgctgcccgagcctgcagaaatccgcggaacggggcgactcctgtgccgggaccgaccataataatcggtttttccggatcttccggcagccggaatcgtgtttccggagtgcggacaaacatcacgataccatcctcagggcggcggtccgctaaataattcgaagcgactccgtgatactcacccaaaccgctccgggcggggccgcgaacgacgccgacggtaattgaggcctgcccgggatgtttccgaggcgaacttgaaatcgaataataccgcggcttcagcgggcgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcggacagaccgtataagcggccatttcccggatttgagcccttgatgccgcttcctgcaattcgacacagctgctcagaagatcatgcagcctgacgggccgatcgagcgggagatgagccgcgctctgtccgctggccgtcagcagcacttgatcattcccgttcagattgaaccggcggagaacacggctgacctgctctttgctgtttaccggcagcacgccgagatgatccccttcatgataggcagcctctttcggcagagtgatttcgatatgccttgtgctccggccgctttccggcgcctgaagttccctgttttccgcaacggatgcgtaaaccgcctcatacgtctttgccaacggagacccgccaagcccgctgacaaattgaaggcccagcgcacttcgctctttttcggcattttcattcagcttgagaccgaatgccttcatggcgtccgtccacatgctttttttccattcatcaagctttccttcaaaatcgccgctgacgtccccttcgcctcgggcagaaaagcgttccgcccctttttcggcaagcttctcatcaatcagtctcggcacagcctgatatgtcgccgcccagttatgatcaccgcagccgaagacggcatatcggacaccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagctcccgcgccacgccttctgcggttcccgtatctgagccgtacaaaatcagaagcggtcggttatcaagcccgataatggatgcgccttttgtttcccgtttttctttttcgacgtcttccgccgctttttcagccgccgggagagctgccgcaacggctcctttgtttctcggccgcacccggatatgaaagtcgccgggcttaatcgtcagtgtctgtttaatatcgagctcataatcggtgtgatcgataaaggtaaaatgctgcagaatcatccccagaacaagagttgcttcatgcagggcgaactgcataccgatacacgccctctgcccgtttccgaaaggcttatacgcatggtgaggcacttgatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataagcgcaatgactcctgcaaaatcattcggatataactaagctccagtacttgtttataagaaggaacgggatcggtcaaaacccgatcggcttcttcataggctttttccaaaacacggggatgtttcagcagaaaatagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccggccgcctgaccggcgctctgcgataatactgtctactaacgaaaacatcgcctgaatgtcatgatgaaattggcgcttcgtcctgatcatgagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcggcaggcacatcaacggcctcatccgggttcagcctagcccatttttgaatcagctgcaccgcgatatcagtcatcatcgaatgataatctttcatcgcgcgctggctgaaggtcggcatcagaatattatgcgcctttcgccagttaggctcatgcgtccagcttgtaaacagcccgtcaccggcaaacgcccggactttctccaaagccccctcaatgcttttatcgaaccgctcttcatcacaaacctctttcaccagttcatggccggacacgacgataatggcgcccgccggcgtatgcagctgaaaaataggcccctgctcgtttgccagtttgatcagcgacattgtaggcttgtctttatcaagcaaaggaagattgccgagaggaccgaatgtcttcggctgcggaatcggacctgtttccttcatgaataacaccctttcttacacattgatgcgttccttccaactacagtgcccttttcaccggccaattatccgccgttacggatcaatccccggattgacgattgataacggttttttctatactggagaggcttgttaaatacagaaataaggtgagttcacatatggattttgaaatcaagtttttatcgttttatgtcattcaagtggaaggaaaagacgaacaggcaaacaaacagttcaaacatttccagacccttgacacagacgaatttgaagaaagcgagctgaaggattttcttgacggggaattgaagaaaatcgtcaaacggaaagctgaacggcatccgcaatccgagcaggtccccacaaaaatcggccattttatcacggagccgggccatgagcttgattcaaatccgaattacaaccttttcaaccgcgccagacttgcggatacgaaggaagcatttatcgaggcaagcgaacagttcgtccgtacttatcttgacacgagcgccgtgcgcggcggtgtttttatcgtggcttcggccgttccgcgcaaatattttgaggacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatatggcgaatcgatgccggaaatcatgaaaaaccaagtcatgaacatggtgcaggagcacgtgtatgaaacttttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggcgaatccatccatctcgcaaaagtgaacgggcgctatgtcgcgctcattgaggcggagacgatctcgtttgaaaaaggcagttcgccggtggagtttcacaagcctgaggggctgcatgaggtgattgagcggatacggaataaatctgaacaagactgacaaaagtccagacgccatgttctggactttctgtatttaataaggctctttgagcaatcgatagcattcaccgatgatgtcttggacgccgggcgttccctttatctcgcggcggacgatttcagatgagagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaaatccgtgcagcaagtctctcacccgttcaaaacgcgtgtcctcgtcatccctgaagtcagcgtcatacggccggatgataaatacgtatcctgttttttcagagagcggcacgaccccgacctgcgtctgcccctttttatacatcagtgtcgaatcatgaaaaaccggctcgggaaaagaaatgtaaaatctgtgcgctcccatgccgagatactctgttttcacttccctttgcagcatgtgatcgcggacagcggagcggatgccgtcaaagccggcgaggatgtcagccgtcgtcgcggttccgtctgcacaatgcaccgttatttcatctgccgtttcttcgtaagacacgacttttttaccgggcagaatcgtgacccccgccgcctcagcatgcttcctgaggatattgtttaacgtttgacgcaatatattattccgccccggcaatgaatcatctaaaaacgcctcactcactttaaactgcagcgttccgttttcatcatgctgcttcagccattccgtttgaaagccgtgttggcagcattcatcatacacaccgatttcctgcagcacccgcagcgcattttgaggctggagaatgcccgctccgctttttcgcatgtcggacgccgcctcgcaaagggtcacttcaaaacccgctctgccgagagaaatcgctgcggacaggccgccgatccctccgcccgctatgatgatctttttcacttcatggttcatcacgataccgccttctcaatttatttatcatttgttaactattagccaccttactatattggctgaaaaactgtcaatctttataggttgccttttgaatccggcaagcttatactttgaatcactaaaatggtacggaggcttacaaaatggaattgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgaacccggccacagcctgagtccgacggagctggcgaaaaaatccaatgtcaccaaagcgaccatcaccggattgatcgacggactcgcacgggacggctttgtaaaccgcagccggcataccggtgacagacgaaaaatcagcatcgaacttacaagggaaggaaaagaaaagctgatgctgtttcttcccggccacttctccaacatttcaggagtcatggaaagcttcaccgctggagaaaaagcggaattgacaaaaatgcttgaagttttatttgataagcttctgctgttttccggagacagaacataaagtagtattgtaaaaacaaaggcaaatttctatgagatagaaattgaagtaaaaagatgagggttataaaaaaacagcctgcacatttgtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgcccccatatgatgctacacaatcaatagaagtagcttttgcagaataagaatccgcatcggtacaaactctcaatacatatgttgcataatctgtactacaaggcataatatccttcccctttcaaattttttgaaacaggtttgttattatgacaaaccctccgttcacttctagctggcaaacgtatgacaaaggggatctcatggcttatgagattaaaaattcaaaactcttagaattaacaaaaggcgcccctcttagcagggcgcctttttcgcgcgattaatcatcactgtttaaaatcccgaaaaaccgaagcaggttgataaacaagttgataaagtcgatataaagcgtcaatgccatcaaaggaatcaggtcagccgtgatgtcccggtgcttgatctggttcagatcgtataagatgtacattgaaaacacaattgttccgatgacggaatacgccatcatggcggcggaattcagcgggctgaaaatattaaagatccccactgcgagaagcgcgataagagcgacaagcaagaaggaccataaaaacgacaagtcctttttcgttttagcgccgatcgtaccgagcaccgcaaaaatgacaaacgaagaaccgaatgcctccaatacgacataggctccggctgcggacgcataatggctgatgatcggaaacagcgtcattccggaaataaaagcgaatgaaaagacaaacacatatccgacggctttttttcggcgcagccaaaatgcggcgatgatcatgacgacctccaagaccgacagcggcagcatcaatgccggcggaatgaactggcccgtatacaggccgattgtcgcaactaacagtgtaaacacaaataccgtgataatgcgctgcataatagattgtttgctctcataagcagcagtttgcatgtcaaaagtcctcccaaaaaatgatcgtgataggtctattataaataaaatgggagaaatttgcatgattttaagaagattttaaggatgtcaggcctgacgtttcgctgcgcactcctgcatatccatgaaatcatgcagttttttcgtcaatccgccgtgcccgaatcggatattccccttctgccccggcgttttcacgaaatcaaggaatgccagcacataaagacgcctgacgggaatcggaatgacgcccgcatcataaaaccagccgtcaattgtattgagcacgcctttatttatgccgtattgcttcgtgcaccaatgcagaaagcgcacttcgggcaggtgcagataccggctctcccgtaaaggaacagttgaatgcttcatatgtaccgcctcctgtcattggctgttttttaagatggttttacttctttgctcttcagggaaaatcgatatttctccaccttatcaatttgtgtcacttgggaattatgaaccgtaatctgaacagtcccgaaatcgagcgtttccagcgcactgataatcttttcgatcacatgcggatctacgtttcctttggacgtcatcatgctccccctttatgtctggccgttcgtcttttgacaatgagtgttttaattcatactattctgataagaaatatataattatactattatgttttcattcagaaatcaacagcatttacacaattttcggatatgttttctttgcgaaaactttcacttccttcgctttgacataaaccgtgtcgccgacgcccgcccccaaggcgtcatattgctgtttttaagaacgcaattttcacgttccgacatgtttaaattgttttccgctgacaaaaaaagcgccccgcctctggacggagcaccttttttctatgcttttgcttcctcgataacacatgtgacacccatgctggcgagcgcctgctccagagagccgtaagtttgatactctgaaaaatcaagtcccaattggatagaagtctgtgccacatcaggccgaatgccggaaaacacggttctgatgccgaggagaaataacgttttcgacagcatatataattgctgcgccaccatcgtatcgacaatgggcacaccggacagatcaattacaaggtttgtgatccgtttggcgacacagttttccggcaccgactccaaaatcacacgcgcccgtctcgtatcaatcgcgccgatgagcggcagagtgccgatcgtatccgcgatcaaaataaccggacagctcaattcggaaataagctcctgctgagatgacagcctcgcgatcattaatttctgaaactgttcagtaaaatccgtcatcagctgatcaaacgagccgttgacaaggtaattccagcggcgggcatcctcatttgttacaatgtcctgatgctcatccataaaacgggtgaccgcctcccaaaagacggttcttgaattgccgatcgcctcaacgacctcatgaacctccgcgtcttgctccactctgcttttcgctacctgagcggcccatttttctttgttatgctgaaaaacggccggatcttccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcgccgatcgcactagagaaattaaaaaaacctgcacattaaagcttttgattgcttttttcggcaggaggatacactataaaagaaatgaaacaggaggtcagtatgatgatcaaaaaaatcgcgacagtcgccgtatacactgatgatcagcaaaaagcgaaaacattctggacggaaaaagcggggtttgaaaccgtcgccgagcatccgatgggaccgggcgccttctggcttgaggtagcgcccaaaggggccgccactcatttggttatttatccgaaatcgatgatgaaaagggccgagcatatgaaggcttctatcgtatttgagtgtgatgatgtctttgccgcatacgaacagatgaaaaagaacggcatcacctttttagatgaaccgaaacaaatggaatggggcagcttcgtgcaatttaaagatgaggatggtcatgtctttctcctgaaatcgtaatccgtcaggcatcttaattgaatttgagaatcattttcatttaaaatgttggataaagcgtaaaaaggattggagagctgccagatgtttgtgcaaatcagaaaaatgaccgtaaaagaaggacatgccgacaaagtaatcgaacgcttcagttcagaaggcgtgattgaaaagcaggaaggtttgatagacgtaacggtcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcatacggcaggacaaacagcggtttatcgggcttccattccgcatacagcacgtcctccgttttttttatgttcagctttttcagctcctgattcagctgcttttcttccagcccggcttctttcagattttcatacagcacttcgccgtcaataatcagcgtgaccggcaaagagacctgcttcggctttatttgcatgtcgccgttcttcgtcgtgtcatattgaaatttcggcaggacgctgaccatcccgtttgtttctaaaattgcgtactccgcttcctgtatagaaaagcaattcgcctgtctgagaaggctttgcaattgattaatgtccagcttattctttttcagcacatcatatttcagttttcctttatgtatgataatactcggctcgccttccaacagctttctggagctttttactttctgcgtaatcagttcgatgagataaattaaaaccccccataacagagaagcaaaaatgatttcaataatcctgacgcctttatcatacaccgcatttccgaccagttcgccgaggatgagcgcggaaataaaatcaaacggcgtaatttgcgagaattgagtttttccaagcaattttaaaatcacaaataaaatacccaagccgcatactaactcccaagccactgtaagtaaatgtcccatatttgcaccttcttcttaaaagtcattaccattatggacattcgcctgttttctatacagcggccggcaatacacaaaaaaacgcagccgaggctgcgtttttttcacttctgcttactgtttttgattcgatctgacgacccgtaagcatacctcagcggcataaccggcggccgctccggaacccgcaaacatcgcggcaagccccaagcccatgccttcccagccgccgacaccgaaaatgctgtaaacaaccgtaccgaaagcagtcaggcccagcaccgccaaaagccactcaggccacatctttttcggccatttcttacggagcacagccgatacggcaaagttaagacaaaatgcggccagacagatcagataaaaaaaccccatgtcttttgcacctccgtcatgaggagctttttatttgctcacctttttttcaaacaaatgataacccggcgcgagtccttttgattcgtaacccattccgctgtaaaacgactgaagcgccttgtttccggacacgcagtcgagccggattttcgtttttcccggacaagacacccccgtctccgcccaagtcatgatcgtccggccgagccccgcccctgcaaaccgcctgttaatcgccagccggtggagatatacggactcctcatgcccttcatcgccccatagacgtctgtcccacccgcttgcttcgggaagcagcatgacgacgccggccagctcttcattctgcctgaataaaaaaacataccctttggcgatcgcctcccgcatattgtgggtatcttccccttgcagaaggccgctccactggttcgatcctttatcgcgaagccattctgccgcctgcacgagcagatccatgacctcttcttcatcatccttccgggcggaggtgacccggaatgcccccgccttctcctccgtaatcgtaaatggtgtcataaaatcctcctgtaatcagaatattcgacacctttattatagaccaaacgcagaaaggaaaaaaacagccgtcatgtttgagggccgtttaaaaaattttcttcttatcacgttcttcttttaaaatctcaaccgcttccctgaaacgcatagagtgaacgatttcacgctcacgcagaaaacggagtgaatcattcaggtcaggatcatcggaaatatcaataatccattgatacgtcgctctcgccttttcttcagccgcaatatcctcatataaatcagcaatcggatctcccttcgcctgtatgtaagacgctgtgaacggaacgccggccgcattgtgataaaacagcgcgctgtcatggttgacgtaatgatcactgagccctgcatcacgcagctgctccggtgtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcacgtactcactttaaccggatactgcagctttttttcatatacccacatttacagatccctccttatacttgccatggccaaggaccgcggccccagtcccattgagcgccggcctgactcacgccgaactgcagaagcggtccgtactcaggctcaaaccgttttctcagctgccttgagtaccgggaatactcatgaaactgctgaagcgcgagacggtcatggggatgcgtatccagataaagcgtcagctccaccaagacaaagtccgccgcctgaatttgctccagcagccgatagtattcatcatcaatctttttcgccatattcgattcccccccgataaggattatcatagaaatcgtaaagatccttccaaagggtcccttttcttaatgcctccatcggagaaaactgctccaagtgataaggctgaaaccgcatataaagatgcggcggcgttctgtagtattttctcccgatcggcgggcagggatcaaaccggctgtggaagggtttataggatttgaccggtgtaaacggctgattttctttcattacgatcctcctttcctaaacacatgaccttaataggtatgaatccgtatcggcatttatgccctgtaagaaaataaaaaagcccgttaaaaacggactccatgcagctcatctggaatttgaagtgaaaaaatcataatgaaaaatctgattgaaagcactgataatgtttcaatgtatattccgtaatttgctgatcatattcaggatattcgtatctcaataaaacagccactgactttgaatatgctctgaagagaccttggcagtcaaacaatgccttccacacgctttcataagtattgccgacataagtattcagcagaatttcccaatccttcgcattcatgtaatgttgaatatacttataattcttccctacacttaatgaaaactgatgctctatcccgatattccacgcaatcatacgcaaaacattaggccttaaaatgtcattcatatgatccagcgcaaacagtatttctttacgcattaatcctttaatcacataggtcgaaaccatccaaaattcattgcagcaatcatcaaactctccgggggtcggtttctttatatgatattgttcatcactcgcaatcatcttactgttgattcggtcatccttgtctaataatatttccgccaaaccatcactctgtgtaaaataatcctctgtttgactcagagggatcaaagttaagtcgattttatgatgatctttaaaaagcatgagataggagaaccagtctccgagttccggagggaaaagttccatatcttcaggtttttgcatcatcattctttcgccaaactgatccagccagctttcatcagatataaaagagtccatatcggtcacaaaataagaaatatcatagtcttgaaatttgtctcgcggtacatttttattggttcttgatccctctaaagtgacaagacggattctctcgtccttcatcgcaatatcaagaatcaatttcatcatttcgtcttcacttctcacatgtaaaacctcccgataaagagatttttacagatcatgcttttcagtttataaacaacttgctcatgatttacagaaatgtcatatgtacttgatgattttgctccaatcgtaccacagctgcaagaacatgagaagagcactcttgctgttccaagagtgcttttcccgaatggtcagatatattggctgtcccgatgatgatggtgatggaacgggtagccgccgtagcctccgccatagccgccaaaaccgtaccccggatatcctccgaagccgccgtagccgccaaaaccgccgtaaccgccgtaaccgccgtaaccgccaaaaccgtaccccgggtagccgtagcctccgccgaaaccgtatcccggatatcctccgaagccgccgtagccaccgtagccgccgtagccgccaaaaccgtaccccgggtagcctccgtagccgccatagcctccgccgtaaatcggtcttctttcattcatgatttatcgctccttcacataggttacagtccagtttatgacatgcggaaggaaacgtatgggcatccgcccagttttggcgaaataatcaataattgcttacggagaaatacgatacaggccggccgcataagcaaaataaaaaggccggaacttatgccgccccggcctttttgtctttattcgcctaaatctacattgtgataaacctgctgtacgtcttcgaggtcttccagcacatcgatcagcttttcgaattgagctttcgcatcttccggaagctcgacttcattttgcgcaagcatcgtcagctccgcaaccgtgaactcttcaacgccggcatttttgaatgcctcctgtacggcatggaattgatcaggctcagcatacacgataacactgtcatcctcttctaaaatatcgcgcacgtccacatcagcttccatcagcaattccagcgcttcatccgccgtcttaccttcaacgccgataacggcagtcgcatcgaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtccttagacgccttcttctctttaatattgttccacttacggcccattttgttccactctctttcacgaattgaatctgtatgataaatactctgcttctattatacctcagcggttgggttgtttcgagtgtaagacattagaaaaaacaggcacgcttaaaatcaccggagcgcagtaagccgaatttgaggattattgtacaaaacataaaaagcctcccttcatacaggaaggaagtcgcaagccaaaagattcattttattcttattacctatttcctacactgtgtaccccgattcacgtggtaatattttgatatcgaacaaaagaaaggattatagtcatgaaagttttcgaagcaaacagcctacccaagaggtgagaacaatgatcgaaacaaatatttctgaacctgtatttcaatttttaggagggactttccatcaagatatagacactcctgagacagcacttgaagaatacttagcagagatacctaaaaaagaacaagaaaacgatgtagtagcactcaaaacgtttataaatagcaattactcagatgaagaaaaaaatgattttatagaagagtctgcagatggtgtagatatcaatagttacggactatccccaatactatggctcggacaagtcattcaaaaaatcgaaaagaatattgaggctttatagattcagggaaaccctattcctatgtttgcacagtctctgataagtttcttaatctttccctctataaaccctcgaatgaaaggatatggtcatgaaagttttcgaagcaaccacccttctcgccgccgccaaacagcgcgcgggtgaatacaaaaaactgcgcggtcaaatggttaatctgaaaaaagcatttcaaggcatggctgctcttggtgacaatgatttctcaggccggggcgctgacaacatcaaagcctttttcaaagaccacgccggcgtcacagacagctggcttgatctgatcgacatgaaaatcgcatttctcacaagccttcccggtaaggtcgaagatgccggactttccaattcgcatgtggaggaatcatttctggagcatgagctcacccacgccctcagtaaatcaaaggcgattatggaagagcagaaaaaggacatgcgctccatcctcggagagatcgaagacatcatctcgcttgatctgttttcaaccgaaaacacggatcagaagctgtcttcagctgacaaaaaaagaagcgaaacgatacataagctcggcaagctcgatcacgatttaacgaaagaatacgcagaaaccgaagcgaacgaacagttcatccaagccgacttccagcagcttcaaaacgccacgggcaaaggaaaaagcgccacgccgcttcactataacgccaaagcgtaccgtgaaagcgacatccatcagaaaaaaggcgatatcgcaagacattcggatgcttatttgaagatgaagaaagaggaagcgaaggaacgagagattgaaaaactgaaagaaagactgaaaaactacgattatgcgaatgctgatgaattctactcaatggccaaaacgatcggctataaaaacctgacaaaagaacagcagcgctacttcattcaaattgaaaacacgcgtgaacttacagacggtttcaaaggcgttgccgtcggcctttatgattccggaaaagacgcggtcacaggcctatgggatatggtcacagatccgggcggaacggttgaagccattacaggagcggcggctcacccgatcaagacgtatgaagccatttcagcggcaatcgaagaatcgtaccaaaaagacatggtgaatggcgacacctactcaagagcaagatgggtgtcatatgcagtgggcaccgttgtgacatcagttgtcggcacaaaaggcgtcggcgccgtctcaaaaacaggaacagccgccaaagtgacaaccaaagtcaaaacagcagcacgcaaatccgccgcagcacaaaaagcgataacggtctcaaaacaaaccgttgatcacatcaaacaaaaagtaaacacaggcatagaagtatcaaaaaaacgtgtcaaaaccaagttacatcaaatcggagatctcaccctggctgatattctcccgtatcatccgcgtcacgacgtagtgccggcgggcgttccttacaacgcagtcaacggggtcacacttaaagaaggacttcagaaattcgccaaggtcatcctgccgaaaccgtacggaacctccgcaagcggcagacggacaccggcaccgcatgtaccgccggtaacggtcaaatacggcgagcattttgcgaaatggaccagaaagaaagtattgaagccgaatgtcatctataaaacaaaagaaggctacacgtacaccactgacaactatggtagaattacaagtgtcaaagcagacttgcagctgggagaagcaaaacgcaaccaatatgcacagtcaaaagcaggcaaaccagaccgtctgacagatgacgacggaggccacctaatcgccacccaattcaaaggctcaggccaattcgacaacatcgtgccgatgaattctcagattaataggagcggcggcagatggtatgaaatggagcaagaatgggcaaaagctcttaaagaagaaccaccccaaaaagttaacgttaatataaaagccatatataaaggtgattcactaagaccagacaaattcatcgttaagtacagcattggagatgctgatttcgaaaaagtaacaataaaaaatcaatctggaggttgagatcatggacacaccaaaaatgggtgaattgtatcaaagaatagcaaatcagataaatgaaatgattccatcagaatgggaaaaagtatatctttacgccgagatattagaggactcttccgaagtatatttttattttaatataccgggcgagagtgaattcttatattcacataacattccagaccattttaatgtaagcgaagatatctatgatgatttattaatcgaacttcaagaatcattcgaagaattacgcgaagagtacaaggaaaataatccgcaaatttggacaaacttgactttgaatctagataggacaggccagttttctatagattataactatgaagatgtaattgcttcagagctaaatggatctcaaagaaaagctatttgggtgtataaaaacctgggtttactgccaaaaaggaaaacggtcagagactttttagaggattatattaagactaacgaaggaaaaatttaaattagtttctgattacgtgagtttattaattgaacttcaagagttattcgaggagttaagagaagaatttaaagcaaataacccagattgttggaccaatttaacgcttaaactagagaataccggtaaattctcaattgactacgattacaccgatgtcatcgcctcagacttaaacggaacacaacggcaagtggtatgggaatatcaaaacttggggattttgcctgaagatgaggacgataaagaatttgtaataaactacgtcggtctataagtcaataatggctcagcacttccttgctgggctattttttataactacatcataccttgtgaatggaaaaaaataatctttatgcagaagtattagatgactctaccatggttctctttcacttcaagacaccagaaaaacgtcaactgatttattcgcaagatctaccagcctgatacagtgtaaataaagatatcttcaacacttttttaagagaaacccgagaactttttgaggaattacgagctgagcacaaaaataattatgatcagatttggacgaaccttacattgacattggagagcaacggtcaattccaacttgattataaagatgatgatattttggcatctgagcttgatgggtatcaaagaattgcattatgggagtacaaaactcttggaattttgcctgaagataaggacgataaagaatttgtaacaaattacttcggtctataaatcaataacgctcagcacttctttgttgggctatttttgataactagaatttctcgatgattgaaggtgaaaagattggaaactaaaaaaaacaaattttgtatcagattattagtgataaaacaaatgacatcatatcttgtccgtggacaaaaattcatctttatgcataagtattaagatactctactatgattctcttccacttcaagactccagaaatcatcaacttattttttcacaagatatagcccctcaatacaacgtaagtaaaaatatcttcaaaactttaagggagatccttaatgtaaacctgatcattattatttttatgttaactcttaattactcacaaagttcaaataattgctttaaattcgaataaatatataaaaagcgtgagaagaaaacttttttatgcatttgaagtattgaagacgcaaaaaaattgattatagtccttatcgccaatcctatcacctaatgtttcttgaagtaccttgctgcagctaggtctatggatcttactatagaagaacagaagtatttgatagagttggcggttttatcaaagttatatctatttcctttgtgccccaacttctttacagaagaaattaaatattttctaatcattaaaatatcacccgaagttaaaacaaggaactcaaaacagaattccttgttttttgttatttctttaatctagctcacacctaaagccttaaatatcgcatctatcggatcagaataaaaaactggctgcacttttaccaataaatctggtggaactgtctgcaagtccataaccgatgctgcaggtattaacactttcttggccccagcatctacacatacttgtaaagtatttgcaaatccctcaactttggaaatagtccccccgactgtcatattaccaataacgactaaactctcctgcgttggctttcccaacgctcctgagcaaagaccaattaattcagcaatcgctaactcatccgttaggccaattccttgcagatcacttatatgcatgagatagtcttttgttttcgtactaatcgtattactaatactcttactattagctgtaaagaaacgaaatgctgtatcaaggctttcctttgcatcacggtttgaaccaacacctgatttatcaaatttaccggttccactaacaacttgattttcgagcttataaatgccaatcattccagattggctatgtccagcaacgtaaacatgtcctggtttccccatgccttctggaattagtttacctccaccttgttctgggactgatacgtaatgttcctctaacgtttccttatcaatataagaaaacattacatcataaaactccattccaccaattttctttaactgttccttaacacgtcgacggccttcaagtgcatactccagtacctcacttaaatctttttttgtaaaatctccatgtggataaaggagctttaacattccagaaacagttctctttatcgcattcgtatcacgctggtttaaattattacctagcttgaaatagcgattaattgcatcactgaatgtacgtttacgcatttcacggaaaaattctgcaagataatcaacaataaatccatatttttcagtgataatgtcaggtcgcattttcggaatctcccaaccaggaagataatagtgcatccgatcaaagaatgccgaatcatttgccatttcttcagggaatggtgcaaacaagtgtgatgttttaattagtgtgtccacactttgattgatattgccgacaaataccatggaagcagaagcattcttttcttctttacctctagcaaaagaacctgaagccatgtaatccttcataatttgaatgccgtctttatctttaaaacggatacccgcaacctcatcaaaagtaacacaatcccacatcccgacaagacctacttttcttgtagacatattataaaatagatttgctacggttgtttgaccacccgagacgagaatcgaatttggtgataactccttatacacatgagattttcctgtaccacgaggccccagttcacacatattgtaattattttccacaagaggaaccaaccgcagtaacaaatgccactttacccgctcttctagttgagttggttccattcctactgaacgaattaagacatcaatccattcatcttttgtgaagctctttctcccatcaaatacctcttgaatgtccaaatttggcatttgaattggttgtaagctactaacattaaagggatttgagtttcgaacctcttcatcataaaaataatcaactttgaccatacaccatataccaccgacaaggagcttatcaaactctttcacatacatggatgaaatgggaacaccttttaaaccaaggtttgaaaactccgcttcataagtatcaattttgggatttaatgctactgttaccttgtcaataacggagtattggccatattccctaatgcgtgattttatcttttccgcctcatcaggacgaacaaagttttcagatagaattttcttcacccgttcaaggccttcacgaatactgtcctcatcgtcagttgcagcatacatccctagtaaatactcgagcacgtatactggaacgttcgctccctctttaataagggtcgttaaatctttacgtacaactcttccagcaaaaacgtcattcaactttttatctaaatcaacagttattccttcattcgctctttctttcactcacggtccacctccctattaaaaatcgaagtcgctaataatacccaagttgatgttaaatggtattttttctactacaacacctgtctcagtatcctttatggttaaataatatgttttatttcgattataaggaatgctctttaatacaaaccttattttgaaagtccgatcagcaggattatcaaaggggcgatctcctataatcgtttcctcgttagatattacatttcccttctcatcagccatatagatgacaactgttcggggagttgtcttgtcttccaccttttcggtttggaaaaattcaagattaaaaatgctatttgttatcttacgggttgtatttgtaagtttaatatcaacttttttaattaccttggcacctttttgtccagtacgtttgtttttaaacaataagagtgggacgacaatctcttgcagacttgcaccaccatgaacaaaattaatacctgagccttgcattttgtatctgagtgttgcctttggcaaatatgctgttaattgctgctcattttttattatggatgacaggttgatagctaattgtcctgatacttcacgctgatcctttgaaagtatatagcgacgtttaacttcaatactatctattgaatcttgtccaatcttatcactttcttctaattcatccctttggtaaaggaaaccatgatcggcagtaataaacacatttgttccactcaaatcatcccgaataattttaactaagtcatacaattggtttaatgaagtttcaacagcattaaatgtataaacttctgttgaagccttatctcccattgcatcaatcgtatcgtgatagatgtatatgagttttttacccttaaaggtttctcttcttcctgctttattcattgctagtacatcttgaaaatgaacagcaatgctttcagccacccttgattcaataatctttttccgatttttcaaaccagaagaatctttcccatcagcaaatacccttgcatttgtatctatgtctatttctttgtgtggtaggagtgatggcattccaatttttgtaatagagggcactacgcctagtaatgtttccacatcacaaacacccattgtctcggtattaagacgatcggctagctcaacgccgatttcataacgcatcgcatccgaaacaataacaaaaacccgctccccatttctaactttagaatcaatgaatgaagaataaaagtcttgctgattttttataccgggtaatgaccattcctgtgtcatttcggactcaaccgcttgggaccaatgggcactcaactcacctatataccaatttgtatatagattttctaccagcatttttaactttttcaatagatcatgattactttcttcatcataagccacataaaacttacggtaatatgtatccattgaatgatattcatctacatatgcttgaaacaaatcaatagcccgtccttgtgggataccttgacgatgttctttataaaactcatgaattttaacggtatagtaaagtgcctcatatagggaagcaaatttatcatagtaatgcttagctcttctcaatttaatgagtttcgtgtattcttcataatcctcaagctgtgtaaccaatccattagctatgaaaatgatgattgctcgatcgagatatgaaaaagtatccgcttgtttaaatgtttcaacaggaagatgattaatgatattcgaaagttgaatttcctgctcagttatttcagcgtattcatcaaataccacatagtcagtcttatggtgcatccaatggtcaataaacacaactgcattcgttttatttcgattggatataaaatcactaagctcatttagattttcttctccaattgattgactgaatgccgttactactagatggatgaacaatgttttaagacttttcttctcccgttcataaccatagtgattagaaacaaaattccagaacacgtcaatatcaaaaaacttctccagaagggaaaggtatttattctcattgtcatccagagtatccattaaaacagcttttaaaacctcttcaaaatcgggtgttctaacgttacataaaacactcatgattgaaagttcaattattccttctgaatatgtttctatatttaatgccgaaaactttctaaaacgttccttattattaaagaaacgttcatattttttaattaccgctcgaagcgatggatctatattcaactcacttagaataagtgaaattctatctgcatagaaagttttcgaataaaaaaccgtatcagctaaccagttatcttccacacctaattccatatttgtataaatcaagtaagaagacataggatcttcttcttcaagcaaatatttcgtctgaaactggttatggtctgtaagcgtatgaacctttactttatcaacggtaagacgttcaatgtcctcagcaaactcattatccttgtccacccaaaacacaatcttccgttgttccccatcttttagtggctcattgaatatatctgataacgcagcctcaatttgatttatgttcattcccttcacctaccttctattatcattatagtggaaagatacatcagcaaaacgccgatgtatcctcatgaagttaattatattttcgcgacaagtcctttaaatttttcataattaactttaaccccatcatctaaatctatttcaatctgcatatctgccatatggtgtaacaaggcatcatacgcttttagctcttcaatcttcttatcaagggattttaactctttcttggcattacttatttcctttgctgtagaatccccttcaataatattaagtaagtctttcttttcagcatctaaacgaatctgatactcatgtaaatagtctgttctaatacgagataaggtggatttatcataacggtgcatgtagataaggcagttaaaggccttttccttaccggatgtaaacaaccaataaattggtctcttattataaatttgaacatggtctttgaaaaagtcatttatgaaatagcgacgcaacgtatcttttgctgtttcgcctttctttctgccaagagtatctgctataaaatcaagattcttgttaagttcttccgcaccaaattttattctaacaaattcaactaggcgagaaacaatatcatctttaaaataggatcccggaagaattgggagaatattatccctatttgccttaaatgttgaatatttgtttatatcaaattctccacctgcataaattaggccttcttcatccaatgaatatctacctaacatgcaccccacaatatatgaaataaacgtttttattgccccaactctatctgtttttttaatagtaacatcttcctcatctacttccggacttaattcatgacttagcccatataattcaatgaaaatcttatttaattcggtttcgttttcttttaaaaggtgaaattgatcatttgtgtacctttcccaatttgaataagcaccttctatggaatcctcaacacaattggaatataaaaatggatgtttcttaaaattccaagaagtttcattagaatcccaatccatctttgatatggatatattcatttctgccaattcttcaaccctattggttagatcttcacttttggttagtataacagggagattattaacatctttcatttgataactcattgtaggattataaagatccataatataattgatgacttttgtattcaaaaggccaataatataattttcgcttattttatcctctaatacatgaaaagtcggcccttttttatcatatattccatctcttgcaatcctgacggaaaatccacgattagaaataccattatatgtcaaaccatccttaaaccaatacttctcgttcaaaagattcgatgtcttattatttttataaaagttccttgcttcttccgaccaatccactacataatctatattcccataccatttccgataatttcctccctttatataaaaactccatttactatttacatcctgagaattaacttcccataactttcttagaaatttattattatctgcggtaatgttttgggaaccagttacatcaatatattcaagaagtttattttcctttacaaaagtttctcctaactcttgtgaaatccaataagcaattggttgaccaggtatcatcttatagaaatcatttttttgagaaaatctataatgtaccccttcatctttaacagcttccaaagtttttatcggttgattttcaacacccgtaaaatcagatagccttatatactcaccatttatatctaattggtagtttctcaaagtaaatgtacaaactgggactacagcgacctcaaacgcattgtattcaagttgaactaaagaactgatattcttctcagcaacaatcctctttcttatatcttcataagcggataggaacatccaaacaaatggtgttattaaaccaatatgccctatcggttttactttttcaaaggaatactcaataaatacagaaaataaatctgtataagcagtataattattctttaaaaactgtgataaatcaggggtcatatatctactccccatatagggcggatttgtaattagtacatcataagactcggtcataatctcagcctgtttaataagtcttggtaaaagctcaatagctcttattcttacttcttcttcaaaaaggtccctcgcaggtttatcctgtagactttttaatctttgttttagaaattcaaaatcacatgtaccaacttttatcagtgagccaaaggtttttgcatttttgaaatactgaataaaatcatgcaccatttcaaaagccttaccatttttttcacctgcaatataagcagtatattcatcatcaatcgagttagattcttggattgatgctaagttcattgataatccttctctttcaatactcctaaagaatcgactattgtattctactgctttcattacaactgaaaaacaagcaagttgatacgctcgatcatctatgtctaatccgtagagattgttttcaagaattaatcttggaatttccctttccatatagccacatttactatatatttcatataaaacatcaaacagataaacaagaatatgtccactacccattgcaggatcaaaacacttaatatcctctacatttaattctttattaatatagagagctagtttttcctcaaaatccggttcaggatttcgattatcaaggtagaattcccaattacctaaaagatcttggtgttctttatgcgactcaatccagtaccgacctaatgaattctgtaccatataacgtactatccagtcaggtgtaaataattgtgtagcaaatggtatttcctctgttttatatttctttttagcttgaattacacgatccttctcttcaaggatgtagtattggtataaccaaccaattatttctaccttacgccagttatcttctgggattttctccgtatctatcatttggcgaataaaggagtccttagataacaatccttctggaaataatatttctttatagtcatcaattgtttcaaacataaatggtaaaaagcgattcaggtcattacaatgcttgataataaggtatttgaataattcctctgagttattgttcatttttagcttatagatatattccttatccaaatctaaatctaaggatagtgcttctttcatcatgtctggctcagtgctatctgcatttgtagatgaaagcacccttacttttgttggtaaataatcatttacctccataaagcgtaaagcagtgaaacggttaaaccacgtataagcaacttcctccatcacacggttgaatccaatttggttaatgcgatcaattaatctatctctttgaatcttttcttcctttaaaagcctcctgccatcaataaagatggcatctgagctttcaatttcggctttttttatgttattttctgtgattcctatcttcatagcccttgcttcgactttttttagtaactctctgcgtgcattcgtagcaaaagtcttgagtgcagatttattcatttacatacacctcaattaatcttcaaactcaatttgtttattttctttaattatctgttttaacttgctggataaggcattgatgtacttatcaacatcatcttctgaggttagtgttcttacattgactaattttgttacttttactggatacttatgaataactggagttacaggcgataatggaggatcagctacttcaccattaggacgatttctttcctcttcttcttttttacgtctccattctgcaatctctcgctcaatgtacccttccattttttccttgaagctagtactttgggaaactgttgcatcaactttataaatatctgtaaaagtatctacattagcattaagttcttgatagtagtgatttactctttctttcgtttcattcgatacaccatattgtgatgtcaacaatgataagtaatcactatcatcttttaattttttatgagcattttctcgcttctcattaaggacaatatatatttgttcatccattgcatgaattagttctggaatgtccttaattcttttgtaaggtataggatcctgaagtatggactggagcttgttaataactccttctacctctgcacctatcaaataggatttactttcatcatattttcttatggctgccaatccatcatcaaagatctttttctgatcagttccgaagaaacttttgacatagacaatctcctcttcccaatcaagtaaatcctcttctagttcctttaacttattgaaataagatacattgtctaagccgttttggaactgctcaaagtattctaatcctttatcgagcaaactcatgccaggatactttctatcttcataacggactttataccccttgatttcgtctatctgtttttcaacaagtagtcgaatgtccttcaatagtccatcttcatcatcagctaaatctgttttattgaaaacatctttacaaatgcttttagctgttttaattagtttttcgtcaactttcacccgcttcaacacaatggctttgtcggcttcctgtgtctttgtaaaaatcgttacaagtgtattaacattatcttcaggttccaagtattctgcattataccgaattcgaatacgttgttcttttaataattgtgcaattatgcctgctatatcaagcgtcttccaaccatacggcttgtctccgaaacggtcgaataaaatcttaattcgcacctgctttttcaagtcgtcttgtaaactgataaaatcagacacttcccgcttagccaactcatttggattcaccttcaaagtttcttcaaaagacaattgttcatcatttgaagcaaggattgaaattaaggctctctcattatctaaatgttcctttatataactgagttttgtataaacattatcgactagcattgtgaaagcagcattaactttctcacgaacagttgacccttttatctctactttatcaccattaataaagaaagcactgtccttaatcgcttcatccaaaagctcacgcccccttcttcgacgttcacgaacttctacttgtttattatttaagatattttgaatgttttcaggaagttgcgtaatattcgttttctttcggaactcctcaatacgtaatgcttcaccgatttcctcgatatatgccttattaccaccaagtttaataatcatttccccgttacctgaagtcatcatcattaattcttgctcggacttatggtaatggtctgataaaggagaaagaatttgcattcctatattggatgtctgattcccataatttttctcatccattttttgattgtaggtaaatgagtattcactgctgtaacggaaacgcttttcatcatataggtcttggaagatgtagtttgctaactcccgcttaacgatgtcttcatcaatattaagggatttgatttctctattgatgtcttgttcgtcatctgttaaaaagataaaattatccccatttttctgtaccaacgtttgggatattagcttacgtaaagaaactttaattttctctttaagctgtaacttatcctcatcaatatgtgtaaccattagagtagcaatattatcgagatttgctggcagttcttttacatatttaatcatgaacagaacctttaaaagatcaatgttaaagtcatcatcttttaaagcaggattttcatatgcactctcaattactcttgaaatggatggattcagaaattcttttattgtatcatagaaggcatagaaaggaataagcgtaccttcctcagcatttttataatgaagtccagcctctttaaatgccgataacatggatcgttccccttctgataaatgtttaccagaggagccgtgtttacgcacttgttcgaatacgttttgtaataacttgaattggtacgggataaaagggtaaacatctgcaaattcctgctcattgtcgtaaccacgtaaatccgctgtgctttctcggaaactaattaagttctttaaaatcgcacttttttcaggataaaggaccttcaatttgtcattagcaaaatcttttttcaataggatacgttttttgataacttcatcgaccgagatggatgaaagagaaagtcttgtatcaaatcgcccctggatacgagagaagtcatcacctttgactttgattatgctatcaatactttcttgggaagtaaccataatccaaaccttacccttacaatgggttccaagatcttcagcaactgtctgcaggttcagcatcaaactacggttatcaccgatgtattgtcctatctcatccacaagaaaaataaggtggaagttttcccccttactattgatgtactcattgacgtctttcgcaaacttttcaatactgatttcgaaattattcacaccgttctcaaaccaatttcgagcagactcttccgtcatatcggttactttcgttaaagcaccgatgacaaaatccgcatcaaagtaaaaactattacgacgttcttcccacgattcaccagctaataacttaaattcggctttaaatgcctcatagactccctgtttatccagatacttctccatctctgcaacaccgggtatatctccgtaataaccacgatgctcataaaaaaccttcataaaaacacggagaattgcgtcttcttttgatttgttatcaagtgaaccttttgaatctatgttgaacagaatgacttctgttcccacatcagccgttctttgcatattcgcatatacaagagggtcttgtactttttcttgaaagaaatcaattgcttgcttcccttttactttcttattttcaagcaagtaagcaaggatttttagaaagtgtgatttaccggaaccaaagaatccagaaatccatacacccatcttatctgttacaccattaatccctttttgatagttctcataaaacttagaaaggtgtttttgcagctcacgggtaacaacatactcgtccaattcctgataaatattaccttcatcttgttgagctactttaatgaccccacgaatatcacgttcaatgtctttttgaaacatatctttaataatcatctaaattcctcctgattcattaatcgactaatcggaatgctcggtaatagttatcatccttaaactttccaaacaattttaatgactgaccatcatatttacctggaaaaaacatgattacaggtatattgtccaaaacttcttgcaaattatttaagatattgtgagaccgaacaaatgggtaaaccttccctattcctgttataaaaaccacattatagtcatccacttgttccttaattttatttagaaacacctcaggcttagcaaatgttgtcatcgctttaaacaatgcttctctgccttgacgttcttccattaaaaaaatgcgatcaaaaattcttttttcctttgtaatatcaatgagcatcttgtacaaatcaaactcgattactcttcgatctgatccttcatagttcaattgtcttttgatccgtttaacgtaatctctgatataaagctcctgattcggttcgtagtcaaacacataaaaactaatttcgttgcccaaaccacgaccttcgataaatttatcttctttaattttatcaataattttatcagccctagctttcaagttactcattctgtcacctcctactcacccatagcatgtacacaacgagaatcgccaatttgagtaagataattttttatcggttcatcaataattagcttatttagttctttactcttcctgtttcttaaaataccgccttcaaacaatacttggatgtaggcacgttttaacttttcaacattaatatcactccaactagctaccttctcactttgctctgctttagaagaaaagaagagattaatgtccttattctctatgaggtaatcattattatgtagcttttcccctattacctcatccatgaactcgaagaacagtaaatcagtcttcataatggcatatagattaagggttttcccagtttcaatagacccttccaacaataaagcagcaagcgtttcatcaataacttctgcccttttcataacggatggcagtgctctattgattcttcctttgttattaaattgaaacagattttcttcttttactttttttcttatttcatctttggctaggccctgttgtttcaactttacaacctgttttaactcaaaaagtaaaaaggacgccccattcaaacttgaagaatattctaaatccattgtcatgcaatcaaacctttcggacaagacttatttcctacttaatatccaatacttttcctaccacagccaagcgtcttttcccacattgctgttggactacttttgtaaactgattgtccttgattaatttttcccgattattttcatataagttcttaattccatctattagctcactttcttttatctcttcccgccaataggaatcaattatcttgtttaaatcaacagctaaatctctctgcgtacggtagaacaacttcaattgcacagatttcacctctaagataaatcttacttaattcttattttagtcttattctatttggaactcaacgaaaaagtaagcttgtttcactatttaaattttaacatttccccttcaactaatagggaaaatgtccttttcgttagtactaaaccgtagatcattaaaacctgaatgagctaagacagaaaagcgtccacagttacaacaattaatagccgatgcacgagctaagaaattggatgtgatactaggctaaagaactttcatgtttggcacataatggtcacctattctatgagattcgtgatcttgtttaacaaagaaagttccatatcattaccttagataatgccataaacacattagaaggtaacaggaaaatgttaggtatttatgcctcgatgtatgaacaggaatcacaaagtaaaagtgagcgagtcggagcaaccttaaggagcagtgcacaaaagggattattcaaagattcaatcctccttatggtaggaaacttcggataagctctgatgaaacacaaacatcgttagacgtatctttagggactatctttcagataaggactttatcacattgcaagggaattatatgaagaaggattccctacacctggacaagtagccgaaaagaaaaacgctagtgataagtggcagcatcgatttgtacaatcaggaaattatgcatgtccttgaaaacaatctaattaacagaaaaagaagtcagaaaagcaaattagaaaatttgagaaggaattagatggctcaaacaaaagaaaaagaaattactcagtttgtttattgacgaaaaaatatccaaaggattatgatggagtgtcagcgatatcaatgacccgacggacattatcaattctaaaaaccgagcaattgaattcttcttttgaaaccaatatcgatgaaattaaacagcagttggatgcttttatcgaatttaaataattaactcaagaaatactccatcgctttcttgagacaattgaaataaaagcagatgaagtccgagaattttttattgattctcgaacccacctgcttcttatttaattaattttagcaatgcacaacactccacatgattcgtatgcggaaacatatccacgggctgcacttcgagcgtctgatacccgccatcctcaagcacccgcaggtctcttgcaagcgtgcctggattgcaggacacgtacaccactcgcttcggtttcatgtcgatgatcgtccgcaggagggcttcgtcgcagccttttcttggcgggtcgacgactagcgtatctgccgtgatgccttcttcgtaccactttggaatgacggtttccgcttctccgactgcgaattccgcgtttgtgatgccattcagctcagcgttgcgtttcgcatcctcgatggcttccggcacgatttcgacgccgtacacttttttcgcctgcttcgctaagaagagagaaatcgttccgatgccgcagtaggcgtcgatgacggtttcttctccttgcagctccgcgtactcaagcgctttgtcgtagagcacttttgtctgttccgggttgacctgatagaacgatctggcggagatggcgaatttgacgtctccgatgaggtcgtagatgtattcttcgccccagatgacgtttgtttcgtccccaaagatcacgtttgttttgtttggattgatgttctgcacgatggatttgacgtgcgggaattgcgccgtaatgtcttcgatgatcttcgctttgtgcggaaaatcgcctgttcttgtgatgaagacgatcatcatttcgcctgtgacgacgccgtatctgaccataatgtggcggagccagcctttgtggcgttcttcgttgtaagctttgacaccgtatgctgcgcagatgtctttgacggcttggacggcttcgtcgtttttggattgctgaatcaggcaggcgctcatgtcgatgatgtcatggcttctttgctgatagaatccggcgacgagtccgccttctctttctcctaccggcacctgcgctttgtttctgtagttccacgggtcttccatgccgagcgtcgggtgcacggtgacgtttgagaggtccagcttgccgatccgttctaagacatctttgacttgtttctgtttaaacaagagctggccttcataggtcatgtgctgaagctggcagccgccgcattgtttgtagatcggacacggggcatccgttctgtgcgggctttcttccttcagctcaatcaagcggccgaaagcgaagccttttttgacgcgtgtcactttgatttgcgctttttcctcaggcagggcgttcggcacgaagatcgggaagccctgaacctttgcgacgcccgctccttcatgcgtcaaatcctcaaatgtcacgtcatagtattcatttttttctatcgggggtttcattttcatctataatcacctctagttttaccaaaagccttgtttcagcgtgctggcaaaccttcaaattcaatgtcagccttcaaaggtttccgatcacgctgaaaagatgacaaaatcctaaaacgaatactgttttaggattttgtccgcgtattagtcatccagctgttccgctttctccttcggcatgatgacgtgaatatgccggtacagattcacgaattcgccgggcagcatgccgccgtattcgccgtccaggttcagctgcatcttttccgatacattgactttcacgcggttcgcttttgtgtaaataatgtgctgatcgttaatatgatcgcctctgagcgccatgctcgcgactctgataaactccgcgagattggcttttttcaaaataattaaatcaaacatgccgtcattcaggctggaatcaggggccagcttctcgaatccgccgaccgagttggtcagcgtcactaaaaacagcataatttccccttgaaacagcttaccgtcatattcaatctcgacttctgtcggtcgaagtgaaggcagcatttccattccctttaaataataagcaagctggccgagcatcgttttcagtttgcttggcacatcatacgtcagctccgtcagacggcctccgccggcgatgttgataaagtactgaccgttcacctgtccgatgtcgatcgggcgggctacgccgttaatgacggtatcagcggcattcagtatattctctctcggaatgcccagcgctctggcgaagtcatttgttgtgccgaccggaatgatgccgagtgtcgggcgtttgtctaacggcgcgaggccgttgacgacttcattaatcgttccgtctccgccggctgcgataatcaggtcaaactcccgcaaagcggcttctgttgcggcgtgggtggcatcccccgcgcatgtggtggcatgggtggaggtttcataaccggcttgttcaaatttttgcaggacctgggcaagatttttcttaaaaagctcccgtcctgaagtcggattgtatattatgcgtgcacgtttcattatctcatcatcctacttaagagtatccgatccattattaacactaacaacctttaattatactatgacttgagaaaatcgcaacaatatgtacaggaattgccagaagaaaaaaggccccggctccgtttaaggagccaaggcccgctgtcttactcttcttccgttccaggttttttcttacggaatttcgctaatacttcatatacgatcggcacaatcagaagagtcagcagagtcgaactgattaaaccgccgataacggtgacaccgagtcctttagaaatgacctggcttccgccttcgaagcccaatgccaatggaagcagggcgccgattgtcgcgatcgccgtcatcagaatcggacgcaatctcgtagagccggcttccaggagcgcttctctcgtcgataggccttccgcttctttatggatgacgcggtcaattaagacaatcgcgtttgtgacgacgattccgatcagcatcagcataccgatcatggcgttcagactgatcgtctctccggatacatacagtccggctaatgcgccgatgactgtaaacggaagcgagaacagaatcgcaaacggcgctaatgctccgccgaacgtgatcacaagaacgaggtatacgatagcgattgcggcaagcatcgctaagccgagtttcgtaaaggaatcagcaatatccgctgatacaccgccggtatcaatggagacattgtccggtttatccagtttgtcaactttcttttgaacggctgatgacaccttcgtgacgttgtcagaagtgacggttgccgttacgtcagcgtacactttgccgtcgcgtttggaaatggtatcggatgtcgtgccgtttttcactttcgccacatcgccgatttttacttcttgacctgcaggcgatgtgatggttttatcctctaattcttttacactcttatactgatctttttctgttttgatgttgacgtcaagctctttgccgtcttttttcaccgttgtcaaaggagactgtgacgtttgggacatcagggcttgggagatttgcgaagccgtcaggccctgcttgctgagtttctcctggtcagcgacgaacgtgtactcatcatatgtgctggaaaggcctgagttgatgtctttcagatccttctgctttttcataatgccttcgatgtctttgaccgtgcctttaatatcagactctgaatctccgtacacatagtacgttaattcgttgttgttgcctgacgaactgaaattttgtgatttccattcgccgcggctggatgtttttttgatttcttttaagacattgtctttttctttgtcaaaatcaggcgtgtcatcctcgtatttcacgtagaacaatgcgccgtttgaacttccgccgagcggactttgcgagcctaaagaatactgaacggtatcgacatgtttgcgtttaagcagcatgtcttccgctttttgcgcagctttttcagcttcgcttttcgtttcgcccggttcaggcgtgtatgtgagctgcatcgttttgtccgcttgcgctggcaggtagctcgcgccgatcagaggtacgaggaacaaactgccgacaagcatcagaaccgcgatgatagatgtaatccatttatgtcttaatgaccaattcagcacttttttatagaaattggccaatctgcccggcttatgctctttcgctttaacaggtgcgcctgtgagcgattttctgaataagctgtgcgctagcatcggcaccagtgtgatcgaaatcaacagtgatgcggcaagcgcgaagacgattgttaatgcaaacggcataaacagttcgccgatctgtccgccgaccatggcaagcggcaggaatacggcaatggttacgatcgttgatgacatgatcggtttaaacatttctttcgtcgcttcacgcaccaattgcttcccgcgtaaaggttcatctttcagcctcatgcggcggtaaatgttttcgatcacgacaatcgagtcgtcgactacccgtccgatggcgaccgtcatcgcaccgagcgtcattatgttcaatgtgacatcaagctgattcagcacaagaagcgcaatcagcagtgacagcgggatggaaacgatagaaatcatcgttgatttaatatctcttaagaataagagaatgatcacgaccgcaaaaatcgcgccgaaaatcgctttgcttaacatcgtatccactgactctgtaatcggctctgccatatcaagagtcgagctgtacttgaaccctttgtggtcttttttgtattgattcagttcatctttaatcgcatcggccacttctaccgtgttggcgtcattggcttttacgatattaattccgatactgtcctttccgttcgtgcgggaaatggattcagcttttttcacatctttaatgtcggcaatgtcagaaagcttgactgtcggcacccctgctgatgcgctttgctgtgcctgctgcatagcctgagcgtccgccgcagatgccgcaccggctccgcccgcttgaccttgagcggcagaagaagatgtgaccggaattctcatctctttcagatctttaattgacgtaatatttccgttaacgacaactgatttttctttgttgccgaatgtgtacaatccaagcggcgtattgacgtcagagccttggatcactttcttgacggtatcttcatcaagtccgtactctttcatttttttgtctttgaaagagaattccacctgctcttcctgctgtccggaaacttgcacggacgcaacgccctgaatgccttcaagcttaggaacgagagtgttttccacatttttggtcagatcttcaagcgagcttttgccgcttgtcacactgagcgtcaaaatcggaaaagagttgaggctgtaacgggaaatgtcaggttttttcgcgtcatcaggaaggctgacactgtccagcgcttcagcgacttcggttttcgccttgtccatatccttgttgtaatcatattcaatcataaccgatgagacgttttcagaggatgtggacgttacgacgctcactccttctaaattctgcaccgcctgctcgatcggttttgtcacgtcatccgcaacttgactcggagcagctccgggataagtcgtatttactgagaggtaaggcatgttgacgtccggtatggattcctgcttcatattcataccggcatacagccctgctacagtaacgataatcgtcatcagccaaactgcgaatttgttcttcagtacaaagttaataatgtggttcatcatgtcctccgttaatttttattgactgactggtcattctatataatactaaacggtataactcaacatcgtcaactaataaggcagtaaatttttctaaatttttcaggattaaggggaagcacgtcatgaacgaaaaaaaagagaaaatcataaaaacaggcatccatttatttgccaaaaaagggttttcttcaacaaccattcaggaaatcgccggtgaatgcggaatttcaaaaggagccttctatctccatttcaaatcaaaagaagaccttttgctgtcagcatgtgagtattacatcggcatgtctatggaagaaataaagaaaatcaaaacagaacatcagcataaaccgcctaaggacgtattccgaaaacaaatcgcttatcaattccaggaatttatggagcacaaggattttatcattctcttgctgagcgaaaaggtcattcctgaaaatcaaaaggtcaaacagtattttcatgaggccaatattcaatttaacatgctgtatcgggatgctttgctctccgtttacggagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattatgggactgataagagacaatcccgatccgctgctgcctgaggatatcttcactcagccggcggcggacagagaaaggctgcttgcggatattcaaaagataaaagcacagcaggggctgcctgaggacgtcctcgtatcgcttgaagtcattgaagaggaatgcgcaaaggaagagccgcgaaaaccgattattaaaggaatgctgtccaacttggcaggcagcggaaatgaacagattgaaacgctgcgggcttccattgaaacctatttcagcttataaaaaaaagagaccggcgcttaccggtctccgtgtcagcagcgcccttagaggcggctgctttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcgggttgctgtcaagcgcatctgttaccagcttcagaagcacgctttcgtcagaaatctgcacgaggcctttttctttaacgattttttctgcgtcgccgcctttttcaattaattctttaaagactttcttcgcgattttggacgagatggttcctttttcaatcagcttaatcatgccggcaaggccttcaggagtcagtgcgacatcctcaagctctttttgttcggcattcaggtaagctgacacttcacccatcagccagtttgatgcctgcttggcttccgcgcctttattgaccgtttcttcgaagaaatcagccatttctttcgtcagcgtcagaaccattgcgtcataagccggcagaccgagctcttcgatataacgcttgcggcgctcgtccggaagctcaggaatggttgctcttacgcgttctttccattcgtcatcaatgcagagctcgacaaggtcaggctcagggaaataacgatagtcgtccgaaccttctttgacacgcatcaaaatggtttttttcgtcgcttcatcgtagcggcgcgtctcctgctgaatgactccgcctgacagaagcacctgctcttggcgtttctcttcatgctcaagtcctttttgcacgaacgcgaaggaattcaggtttttcagctccgtttttgtgccgaatttctcctggccgatcggacggagggaaatgttggcgtcacagcgcagtgaaccttcttccattttacagtcggaaacacctgtgtattggataattgatttcagcttttcgagatatgcgtaagcttcctcaggtgtgcggatatccggctcagatacaatctcgacaagcggcgtgccctggcggttgaagtcaacgagggaatagccgtcgcccgtatgcgtcagttttcccgcatcttcttcaaggtgaagacgggtaatgccgatttttttcgtttttccgccgacttcgatttcaatccagccgttttcgccgatcggcttgtcaaattgagatatttgatatgccttcgggttgtccgggtagaaatagttttttcggtcaaacttcgtatccgttgcgatttcacagttcaaagccattgcggctttcatcgcgaattcgaccgcttctttgttcaaaacgggcagcacgccgggatagccgaggtcgatgacgcttgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacgcggtatacagtgccttcatcgaagtgttttccgatgatttgcagtccgagcggcagtccgtccgcaaatccgcacggcacgctgattcccggcacacccgcgaggttgacagggatcgttaaaatatcgttggcgtacattgtgagcggatcgctggttttttcgccgattttgaatgccggtgtcggcgttgtcggtccgacgatgacatcgtatttctcaaatacgtcttcaaaatcttttttaataagcgtgcgcactttttgcgcttttttgtaatacgcgtcatagtagccggagctgagcgcgaaggtgccgagcatgatgcggcgcttcacttcgttgccgaagccttctgagcgtgtctgtttataaaggtcgatcaggttgtccgcattgtctgagcggtagccgtagcggatgccgtcaaaacgcgcaaggtttgcagacgcttcggaagaagacagcagataatacgtcgcaagcgcgtatttgctgtgcggcagagatacttcttcccatgtcgctccgaggtcttcaagcacttttaaagcggctaaaaccgattctttcgcttctttgccgacgccttctccgagatattctttcggcacggcgatttttaagcctttaatatcgccagttaatgaagaaagaaagtccggcacttcgacattggcgctcgtagagtccattttgtccgggcctgaaatcgcctgaagcaggaatgcgttatcttctacgtttcttgtgatcggtccgatctggtcaagtgaagacgcaaaagcgaccaaaccgtaacgtgacacgcgtccgtatgtaggctttaatccgacgacgccgcagaaagaagccggctgacggatggagccgcccgtatcagatccgagtgaaaacggcacttcgccggctgcaaccgcagctgcggaaccgccgcttgatccgccgggaaccgtatcgagattccaagggtttttcgtcgctttgtacgcggagttttcagtagaagaacccatcgcgaactcgtccatattcagctttccgattgtgacggcttcagcggcttgaaggcgttccacaaccgtcgcatcgtaaatcggatcgaagttttcaaggattttgcttgagcatgttgtgcgaagccctttggtcacgatgttgtctttgacgccgatcggcattccgaagagaagaccgtgttcagaccgtccgtcaaccgcttcgtcaagttctttcgcgtaagcgcgggctctttcttcatcaagctgtaaaaacgcctgcaccttatcatccacggatgcgatccgtttgtaagattcatcaacaagatcggaaatcttgatttcttttttatgtatcatttgtttcaattctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgtttttcattttcagcacgtgtgttgtcggttccacgttatccgtgtccacttcattaagctcctcggcaaacgagatgatgctgtcaagctgttctgtgaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccctctctattttatcctaaatcggggagaaagagaaacgaattatatgtcagaaaatttttacttttataatttattggtagcgttttcatctttaagctgttctaggttggcggggattttttccttgagcgggccaggtttcgagagttgattgatcggggatactttgttaggtttagtaaccatagccggcactaaatcatgcgatccccatcgaaagatgactaaaggcaggctggatcgccggcgcatattccggcactactaatctacagaggtgatgcaacatttacatgaaagaagagagggtccaaaaacgtgagtattgaattaattatatctcttggcatttactttgccgccatgctgttaatcggctggtacgcattcagaaagacaacgaatattaatgattacatgctgggcggaagaggactcggtccgttcgtaacggcgctgtccgcaggtgcggcggatatgagcgcatggatgctgatgggagttcccggcgcaatgttcgcaacggggttatcgaccttatggctggcgctcggtttgacgatcggcgcgtattcaaattatctgctgcttgctccgaggctgcgcgcttacacggaagttgcggatgatgcgattacgattcccgattttttcgataaacggttccgccactcgtcatcattgctgaaaattgtttccgccgtgattattatgatctttttcacactgtacacatcgtccggaatggtatccggaggcaggttatttgaatcggcattcggcgccgactacaaattcggtttgtttttaacggcgggtgtagttgtgctttatacgctgtttggcggtttcctcgctgtcagtctgactgactttgtacagggagcgatcatgtttgcggcattagtgcttgtgccgatcgttgcttttacccagctcgggagcgtttcaacgacgattgattcgatcaacgccgttaacccgaaactattggatatctttaaaggcgcgagcgtcattagcattatttcttatttggcatggggactcggctattacggccagcctcatatcatcgtacgatttatggcgattaaagaagtgaaagatttaaaacccgcccgcagaatcgggatgagctggatgtttatttcagttgtcggctcattgctgaccgggattatcggggttgcgtattctcatcacttcggggtctccgtaaaagatccggaaacgattttcattattttttctaaaatcttgttccatccgctgattacgggcttcttgctgtccgcgattttagcggcgatcatgagttccatttcctcacagcttctcgtaacggcaagcgccattacggaagatttataccgcgcctttttcagacgggaagcgagcgataaagaattggtcatgaccggacgcctgtcagtattgatcgtagccgttattgccatcctgctatccatgaatccgaacagcaccattcttgatctggtcgggtatgcgtgggcaggcttcggttcggctatcggcccggcgctcttgctcagtctgtactggaaacggatgaatgaatggggagcgcttgcggcgatgattaccggggccgcggccgttttaatctggattacgacagggcttgccgcttcaaccggcgtatacgaaatcattccgggattcttcctcagtctgattgccggtattgccgtcagcctgctgaccaaaaaaccggccgatgcttcttatcagctgttcagccggatggaatctcttttgaaaaacaagaaatagacaaaaagccgtcagattttatccctgacggcttttttcttccgcacttgtcctgctataaatactgtgagaaaatcatatcaatttattataagaaaaattgcggaggtgctgtgcaaattgagctggcctatcgaaccagacattttattaaagctgggcattgccacgctgatcggcatgatcatcggtcttgaacgcgaactgaaaaacaaaccgctcggactgaaaacctgtatcgtcatcgccgtcagctcctgtatgctgacgatcgtcagcattaatgcggcatatcatttcccgaaatattaccgtatcatgatggatccgctccgccttcccgccgctgcgtaaaagcaatgacgtcatatccggcctgacgacatcggctatcatctggggcgcggccgggctgggtctggctacaggcgccggcttttataaagaagcgttcgcaagcctcttgtttatcctgatcagtgtcgaatttcttccgtggctgatcagaaaaatcggtcccaaccgcttgaaggaaaaggatatccgcgtgagaatgtctctttccgataaagacaaaatgaccgagattttaaaggaaatgaaaagcaaacagctccgcattcactccgtccggattgatgacctgggtgaaaaagaatttccgattatggaagtgaaagtcagtgttcataaaaaccgctacaccactgacgtctattatgatattaaagaaattcagggtgtcgtcggagtaaaatgtgatacgttataaaaaacgccgggctggattcagccggcgtttttctatttatacgaatgcagaaaattgatactccgtaatcggtgtttcattttcgatatcgcgcctgaaggctttcagcatcccgagttcctcgtccccgagtgaattgaggtcaaacgcctgatgcaataatccgtagatcagcatatggcgcagccggaggaaatccgggatgtgttcaagccaggcgggatcaaggtcattttcttctctgtagcctttcataaagtgagtcatgaattcacccgtaaacgcggccttgtcttcatacgggatgaccggataccacaacatgttgtacagcagaatactgatatcattcacaaaccaattgtagccgatatcatcaaaatcaaatgcagtgatttttccgttgtcccaattaaaattgccatgatgcagatcggcgtgcacaaggccgtagtttttaggattcttcggcaaacggcgcagtttttccattagagcatccgcccgctcaaatacgagatgctgatctgcgggcacgtattttctcagcttcagctgctcctcttcatcccattcctgccttttatatgccggatcgctcagacggtagcttttcgtcagccggtgcatgttccccgtgtactttccaagctggtaaaacagagttccgttccagtctgattcctccactttgcgtccgggcgctttttcatagactcttaataaaaatgctccgccttttccgtccggcacttcttcgacatctttgccatttaatgaaggaatcggctttgctactgaaagccctccctttgccagatgatgaagccattccatttctccgagaatatattccggcgttcttctgatcgtatgcgtaatttttaagatatacggttcgttatctttcacaatttcatatacgtagttctctgcgtccgcaataaattgaaacttggtaaatccgtatatttcaccggcttcagccagcaccttatcttcctcaaaaatcgctttaatatctttatgcatgctgattcacccttttcataacatttgtaggcggtgtgtgtactcagcaaatgtcattcatcaacattcctgcccttcttttttcacagcagattcgtaacatccgcttagaaatgaaatgtgttttcctgttaattcctaattatacaaatatcttaacatacctcattcctctctccaacgatattcacactaaaaaacccttgctcatacagaaatgaacaagggcatcttggttaatcgtaaatatggacggtcggttctttgtcacccgcattgcggacgatcagcgcttcctgcccgtcagacgaggtaatgttaatttcgacatcaactgagccttttgaataataatccatcagctcacctgttaagtattgggtgaaggcgatgacttcgcttttcccgtaaaattgcatcgggatttcaatcttcatttttctcatttcatcgttttcgtacattgccgttccgacaactccggtgtaattcgggaagtagctgtcgatggcgtttttgaagcgtttaaacacttcggaatcatcagggtatttctttgccgtgtctgtatccgccggatagaagacgtacttttctttgacatcatcccagtttgaaatggtggatgagccggccttgacttctgttttcgcaatgtaattccccggtacgattgatgttttcggcgcttgtttataaagggcgacggtaatcggcacatttttcaggttatccattttccgaaggcggttaacgacttcctgtgcgatttcttcaccgtggctgcggatcgttttgtcgctgagctccacttcctgctgcggatcacctgtgttttcgcggtaatagtatacagagttgagagcgagaccgatcataacaccgccaagctggatggaatttttatcttttcttactaagtaatcctgctcaagcatggacgctaagtaaatcgggctgttttcgtttttctcttttgctgatcccgagcttggcagcaccgggtttaagccgagattctggaaattggcgtctgcctttttcgcctttttcagatcactgccctcttttttgcggtcaagccagctgagtaccgtgtcctcatctaaatactggccttcctgatacaaatagtcatccgtcgggaacgtgtcttgagcgagccgcatcagccccgtctcgaattcatcgatgtccagcctcgtgttcagccggtccgcggtcaggccgcgcgcttttccggccttaaacgggagcaccattttatagtaggaatcagagatattatatttcggtatgatcgctttttcagaagactttgccgttttctgcgtgatctcttcctctttttttcccccgaaactcggcgaacaggccgacagcatgagtactgccgccgttgccgtcgccgccaatgccaacatctttttcaatagaaaacactcctcttatttctttagctctcccaatagctgtgcttcattccatacttcaatgtttaactcctgcgcttttgtcagcttgcttccggccgcttctccggcaatcagcaagtctgtttttttgctgacagatcccgtcagctttccgccgagcgcttcaatctgcgccttggcttcatttctggacagctcttcaagctttccggttaacacgatggttttgccggcaaaataagagtcgctgtcctccgcttttacttttttcgggcctttgtagagtgtgttcacaccgagttcctcaagttcattcaaaagctcaagcatttcctctttgcggaaataggtgataacggcatcggccatcttttcgccgatttcatctaccgcaagcagctcttcttccgtggcttgtttcagattttccaggctttcaaaatgcatggccagtgttttggccgcttttgagccgataaaacggatgccgagaccgaacagcaggcgttccagcgaattctctttcgacttttggatggagctgatcagattgtcagttgatttttcccccatccgctcaagccggatgacctgttctttcgtcagcttatacaaatcagcgacattacggacgagatgttcacggaaaagctgtgtgatgacacgttctccgagtccgtcaatattcatcgcgttgcgtgagacaaagtgaatcaggccttctctgatctgcgccggacattccggattgatgcagcgcagcgcgacttccccttcaatgcggacaagttcgctttcgcactcagggcagctggtcggcatattgaattctttttcttccccggtccgctgttcaattaagacattgacgacctcagggatgatgtcgcccgcttttttgacgaccactttatcgagaatgcggatatccttctctttaattaaatcttcgttatgaagggatgctcttgagaccgtcgttcccgcgacttttaccggttccagaacggcggtcggcgtaataacgcccgttcttccgacattcagttcgatatcgagcagttttgtcacgacctcttcagccgggaatttgtaagcaatcgcccagcgcgggctttttgccgtatacccgagttcttcctgctggtcgagcgaatcgactttgatgacgattccgtcaatttcataagggagatcggcccgcttcgcctgcagctcttcgatcatttcaatgacttcatctatcgtgtcgcattttttccgttcctggtttgttttaaaaccgagctcatccagaaaatccaggccctgactctgtgtttccacacccatctcgtcaagctccgctatactgtagacgaagatgtcaagatttcgtttcgctgcaattttcggatcgagctgtctgagtgagcccgcagccgcgttccggggattggcgaacggctcctcttcatgtttcagcctttcctcattgagcgcttcaaatgactgtttcggcatgtacgcctctccgcgcacttctatggaaagattacgtttcattttcagcggaatgttgcggatcgtttttaagttttcggtgatatcttcgcccgtcgttccgtctcctcttgtcgcgcctctgacgaaatagccgtcttcataacggagagaaacagcaagaccgtctattttcagctccacattataagcgacgccgtcaccgacagcctgacggacgcggcggtcaaaatcgcggagatcatcatcgttaaatgcgttgccgagactgagcatcggcgtgccgtgctgcaccttttgaaaagattcaagcaccgctcccccgacccgctgtgtgggcgaatcaggcgttctgagctccgggtgctcttcctctatggcaatcagctcctgcatcagtctgtcgtactcggaatccggcacgctcggttcatctaaggtgtaatattcataactgtactgatcgatggtgcggcgcaattcttctgcccggtgtttcgctgtttctttgtccatcatgttcttcctttcctcttcaggttactgcttttcaatcggcgcaaaagctgcaagcagacgcttcacgccgactgggctcgggaatgcgatatcaagctcggtgctttcgccttctccttttacactgacaaccgttccggtgccccattttttatggcccgctttatcgccgaccgcccagctgagcgagtcgccgcctgttttgttcgcgtaggaaacgggacgggatacgggcccgcgtttcggctgcacttttcgtcccggctgcatgcgaggtgttttcttctcatttaggttctccaataaatcgccaggtatttccctgataaagcgggattccggattcatattggtgcggccgaataaggttcgcattttggcattcgttaaatacagttcttcttccgccctcgtaatgcctacatatgcgagcctgcgttcttcttccatctcggcttcttccatcagggagcggctgtgcgggaacacgccttcttccatgcccattaagaacacgacaggaaattcaagtcccttagcggcgtgcagtgtcattaaagtgacggcatcctttccgcctgattcctcttccttctggtcgagctggtcaatatccgcaatcagcgccaaatcagtcagaaacgcgacgagagacttgtcttcgcttttttgttcgaagtttttcgtcacggaaagaaactcgtcgatattttcaaggcggctttgggcttcgattgatttttcggccttcagcatttctctgtattccgttttctcgagaatttcttccgtgagttccgtaatggacaggtaatcctgcatgttcgtcagattttcaatcatcgcgccaaagccgtcaagcgcgtttgccgcttttgcgctgactccgatgaaatcaacctgtttgatcgcctggaacattgacattccgttcatcgccgcatatgaagcgattttttctagcgaagtggcgccgacgccacgcttcggcacattgacgatccgcgtaaaactgatgtcgtcgtccgggtttgacacaaggcgcaggtatgcaagaatgtctttaatttctttcctgtcgtagaacttggttccgccgacgatattgtagttcagtccggattttaaaagggtttcctcaatgacgcgcgactgggcgtttgtccggtataaaatcgcgatatcggaaagcttccgccggcccgagctgtgcagctcataaattttgcccgcgacgaattggccttcgccgaattcattgtcgccgctgtaataagaaagcttgatgccttcgtcattttccgtccacaggtttttcggcttgcggtttgagttgtttttgatcacttcgttagccgcctgcagaatccgctttgttgagcggtagttttgctcgagcagaatcacgtttgcgctcgggtaatctttttcaaaggaaaggatattcgcgatatccgccccgcgccatctgtaaatggactggtcggagtcaccgacgacgcagatattttcaagacgggccgcaagctgcttcacaaggaggtattgcgccctgttcgtatcctgatactcgtctacgtgaatgtactggaatttgcgctgataaaactcaagcacttccggcacacgctcaaaaagcttaatcgtcgtcatgattaaatcatcaaaatcgagcgattggtttttcagcagttttttctgataatcggtatacacgtcactcgtgacctgatcgtagtagccgccagccgtttttgcgaattcctcaggttcgatcagctcgttttttgcgctgctgatggagcctaaaatacttctcggatcaaactttttcggatcgatattccgctctttcaaaatccctttaataacggaaagctgatcagccgtatcaagaatggagaagtttcggttgatgccgattctgtcaatatccctgcgcagaatccgcacgcacatgctgtggaaggtggaaatccagatttcatccgcgccgggtccgagaatgctctccacccgctccttcatttctctggcggctttatttgtaaatgtaatcgccagaatgttccatggcgccacgtgtttttccgccattaagtatgcgattctgtgcgtcagcacacgtgtttttccgcttcccgcgcccgccatcagaagcagcggaccgtccgtcgtcttgaccgcttcctgctgaacgggatttaatccgcttaataattgattgctaatgtaattcatatccgttcaccgcctatcaaacatatgttctatcataaatcaatttcgtccgcttggctactttgtctttacagccgccaccgttttgagcgcctgatcaaaatcttcatatacggcatttccgacaacgatgacatcggcatgacggccgaaccgttccgccgtttccgcgtctttaatgccgcctccgtaaaacagaacggacttgtccagcacagccttcgttttctccaccgtttctatgtccgccagcatcccgctgtattccagataaaaaatcgggagatgaagcaaatgttccgcgacccgcgcataggcgagaatatcttctgtttctatatgtgtatccgcctccgtcaaagcggccgccttacaatcagggttgacgatgcagtagccctccgtcacgatttcctccattgacatgagctctccgtattctttcatcgcctgatgatgcatgccgacaatccagtccgcctttttgctgttgagcacactcggaatgaaataaagatcaaacccgggcacaatggaatcaatcgtcgacacctcaagtacgcacggcactaaaaaccgccgcacctttgacatcagtctcagcacattgtcctcggtgatattgtcgcttcctccgatcacaatggcgtcagtccctgattcacaaagccgttccagctgttcatccggtaaatctttattcggatcgagtttaaaaacatgcttccactcgttaacatcgtacatgcgttttcgttcctccattcgtttcttgccatttaaacattataacaaattcgtttggcccggaaaaacggaaaaagacgtcattcacctgattcacaaaaaaagattgcgctccgccggacgggaaacggctatgtttgaaaacagacaaaatgtggaatgtcaaagagaaaaaaggcaaggagtctgatctcaatggaacaagccattatcgtactgatttgtatattgatttttattattttagttcccgccgcattgtttctctggatttacataagagacgaaaagcaggaagaacattcagtgctgcgcaattatcccgcagcgggaaaactgcgctatatatttgaaaaaatcggacctgagctgcggcagtatttattcagcaatgataacgaagaacagccgttttcccggagagaatatgaacagacggtcatgtcgggaaagtataaaagcagaatgatgggcttcggctcagaacgggatttcgatcagccgggctattatatccgtaacgccctcttcccgaaacaaagggaggagctgcgcacagatcagacgccgaagatcgacacgatggtatacaagattgacaaagacaacctgctgaaacgcagcgaacaccgcgaaaaagcaaaagcggacccttattacctgcatccggacgatgtgcaagtgatcggccgcgacacatgcaagaaaccgttttatgtaaaagggttaatcggacaatcagcgatgagctacggctcacttggcgaccgggcaatcaccgccctgtcaaaaggactgcaccaggccggcggcacatggatgaatacaggcgaaggcggcctgtctgagtatcacttgaaaggcggcgcggatattatctgccaaatcggccccgggctgttcggcgtgcgcactgaagatggagaattttcatgggaagaatttaagaaaaaaagccgcctcgagcagattaaagcctttgaattaaagcttgcgcaaggggcgaaagctagaggcggtcatattgacggttcaaaggtgaccgaagaaattgccgccatcagaaatgtgcagcccggacaatccattgacagtccaaaccgcttcaacgagttctcaaatgttccggacatgcttgatttcattgagaaattaagaactgtcggtgaaaaaccggtcggcatcaaaattgtcccgggcagccgcaaagaccttgaagaccttatttcctgtatgagttcatcaggcaaacttcccgactttattacgattgacggcagtgaagggggaacgggagcttctttccatgagctggcggattccgtcggcctgccgattctgaccggcctcccccttgttgacggccttttgaagacatacggtataagagataagctgaaaattttcgcatccggaaagctgctcactcccgataagattgccgttgccctcgcgttaggcgcggattttgtcaatattgcccggggaatgatgttttcagtcggctgtatccgcgctcaagtatgccacaccaatcattgtcctgtcggagtggcgacaaccgatccaaaacttcagcgcgcgctcagtatcgaggataaacagcatcgcgtctgcaactacgtgctctcgttgcgtgaagggctgtttcatcttgccgcggcggcgggtatcagctcgccgattcatttctcagctgaacacatcgtataccgggaggaagacggaagcctgagggaacttcccggccttttgaatcagcacgcataaaaaaaccgcctgccgtcatcggcagagcggtttttacgtagctgaggaggattctcctttgtttacgcggtcaagcgccatttcataggcgtcgttaccgtaatttaagcagcgcttcacccgggaaatcgtcgctgtggaagcacccgtttcgctttcaattttgtgatacgtatttccttcgcggagcattctcgccacttccaaacgctgcgccagcgattggatttcattaatcgtacaaagatcgtcaaagaaacgatagcattcctccagatctttcagcgataaaatagataaaaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacggccgtctttatattcccagtctgactccataacatcgccgtgctgaagcaggaggcccttcccccctgactgaatatcgatggcccgccttccatctttgtctgtcatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaacattttgtgttccataatctatccgaatattgtaggtttcgtttccgggttttgcatctgatgtctgaaatgggagcggttctgtttttccgttcagcttgtatcctttttgttccgccgccttcctgatattgtcatacgacgtgtaggaattgtggggcggcttgctgaaatcggctctccaaaacaggctgccgtcaaaatccaaaccgtttatataatcgtaagttccggactccagctgctttttagcgccgggactccagccatgatggacaaatatgctgttaaacccgctgctgagcgtgacaaaatattccctcgcgctccgcacaggcccgaccgtttccggcatctcactttgaaaaatcgcgagaaaccgcgtaatccggccctccgcgagcgcttcgatgacaacatccgcctttgacagcccggattggggcctcgccttcggatgattgttcactgcgactgcaatcggactgcgttctgcaagcttctgctcagttttcagccccgttaaaggagcttccgcttctttcggctgcacctgatcggcattgttctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcggatataaggcaggtgtgtgctctgcaaaaagagcagcgtatagatcggatcgcagaatcggtagccccgctcctccagcagcgtcctcagtttttgctctttctcaagcacttcttcataattctccgcggatgcagaaccgtttaaagcgaggggaatctcatgaagaatcttcccgttttcggcaagcacgattccgccgccgatttctttcatccgtgagaaagcgagcaggatatcttctttattttttccggcagcgataatatctccggttgtcgtgtaggaactgacaaagccctgcacccgatcggcaaaacctttcagcattgtattgacccgccattttccatgcttatcgagaagcgtgagatagcattcatcatgatcaaaagaaagctggtcaacagaattatcaatcgcaatcatatacggctccataatgacggcgttgcgcattatcacacccatcggcattgaaaactgtaaatcatccatcgtcatatcatatgaaagctcaagagggacaagaccgccctttttccaatccgtttctgtaaacgcattcatatttcggccgtcttccctcagcaggatgcctttggagatcaccgtgaccgggtccggattcatcgggtcatcgagaatgtttaatgaagcaagccggcccggaccgatcacaccgagaaagtcatccatctgataatatttcgcgatattaaaggaggccatattgtaggcgtcaatcgccggaaccccttcctccaaagcgattttgattaattcattcgtcatgccgcctttataaaaatgcggcgtcgctccatccgtcgtgtaaaagaaatgatcataatgccggaagcctttttgatggagatcctgcaaaatcgttctcaaatcagggcggatggatgaatgtctgagcgaaacatagtaacccaattcaagccgtctcatcacctcgtcgccattcatcgcttcgtggtcagaatcagccccgaacagtttcatcttcgtcagtgttttttcagaagctccgggaaaatgcccttctatccgcttgcgcagtttctttgtcgcctgcatgcaatgaagcatcaagtcatcgccgtccacgaggcgcggccatccggtcaattctccgccttgaatgacatccggatgctcaatccattgcttgcggacatcaaaagaaaggagctggtcctcattcagcacttcagtctgcagatcatatctggaccaccagaaatattgcaccggctgtttttttagttcttccaatatagtaagcgctttctttttaccgctgtgcaaaagaaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatgaccaacatatacaattcggtctccgtaaatccagacgttctttttcagccattgttttaaaaaaggatttaatacgagagcatcccgtaaaagtagcgttggaagcagctttgagtctacaacatccgcctgtgatctgatgtctttatttttccagttaaaggtacgttcggacattcacatactctccttcgcttatattagacccatcgtatcacatccgcacaattatcgcacggctaaaacgttacaaattattgaagatgaatgaaaaactttttctaagggagctgaaatgatgaaaccgaatatcagtttattaaacgccgttatgcgcatcacttgcggcctcaccattttgtctgccgcttcagcaaaatacacgagaaaaccttggtgcaagatgcatctcttctgtatgatgatgggcgcgatgaaagcggcgtccggcatcctccgcttctgtccggtgacatatatgttccaagccggaatgaatcaggatgacagccatcagcaagaaaaataacaagccgtttcggcttgttatttttttctcctgtcccgcgagtatgagaagaatctgccggcgatcccggcatcacaaaagccgggacagaattcaagactgcatgacaatcttagtcgtcattcagaagaaaacccgcatcttttaagacgcgggggtttcctctttatcgctgcgatgctttcagcgcacgggcgccgatatcgcttctgtaaaacagtccgggttttgtcagccctgaaacggcgctgtacactttatccctcgccgcttcaaatgtctcagcaaatgccgtgacattggcgacccggccgccgttcgtaacaaattgtccgccgtcttttttcgttccggcatgaaaaacggcgatcccgtcttcagcggacgtcaaactgccgatcggcgtccctttcgcatagccttccggatagccttcagaagccaggacaacgctgaccgcggccgtatccttccatcttaggtcaacatctttctcatgcagaagatctaagagcacctgaatgaggtccgattccattctcggcacgacggcctgtgtttccggatctccgaagcgcgcgttgaattcaatgacctttgatccgttttccgtcagaatcagccccgcgtacagcacgcccgtgaaggagcgcccctctttcaccattgcttttgccgccggcttcacaatcgtttcgactgcgcttctgacgatatcatcggaaatgtgcggcaccggtgagtaggctcccattccgcccgtattcggccctttgtctccatcgaaggcgcgtttatgatcttgagcgatgaccatcggatagacggtctccccttttacaaacgccattaaagaaaattcttcgccggcgaggaactcttcaatgacaacagatgcgctcgcctccccgaatttctcatcctcaagaaaatcgtgcaggcattcaatcgcttcttcttccgtcatcgcgactgtgacaccttttccggcggcaagcccgtccgctttaatgacaatcggcgcgcctttttgctgtacatatgctttcgcctcttcaaatgaagtaaacgtctcatactccgccgtcggaatgccgtattttttcattaaatccttggcaaactgtttgcttccttcaataatagccgctttttcagacggtccgaaaacaagcagtccggctttttcaaactcgtcggctatcccttcaatcagaggaacttcggggccgataatcgtcaggccgacatgatgttctttcgcaaacgcaatgagtgcggcatgatcgctttctccaatgttgaccagcgtcgcgcagtctgtcataccgtcatttccgggcgcggcgtacaccgtgtcaacaagcgggctttgcgccgctttccaagccaatgtatgctctctgccgccttttccgataatcaatacattcacgcttcgttccccccttaatgtttgaaatgtctgatgccggtgaataccatggcgattccgtattcatccgcttttttaatcgaatcttcatcgcggaccgatccgccgggctggataatcgccgtgacaccggcttttgcggcttcttcgactgtatccggcatcgggaaaaacgcgtctgatccgagcgcgctgccttttgctttttctccggcctgctcaatggcgattttggctgaaccgacgcgattcatctgtcctgcgcccacaccgaccgtcatatggtcttttgcaaggacgatcgcattggatttcacgtgtttgacgactttccaggccagcttcaaatcttcccattcctgctcgctcggctctctttttgtcgggatgctgatgtcggcgtcatcaaatccatggacgtctaaatcttgaatcaaaagaccgccctgtacggaagtcagctgtttttctttctttcctgatgcggtcacgtcaagcgtgagcagacgaaggtttttcttcgccgtcagcacgttcagcgcttcttcactgaaagaaggggcgataatgatttctaaaaagatgccgtgaagggcttcagccgttgcctgatcaacttcacggttcagcgcgatgatgccgccgaaaatggaggttttatcagcttcatacgctttattgaatgcttcctcaattgaagctcccgtaccgactccgcatggattcatatgtttaacggcaacagctgcgggttctgtaaattcccggacgatttgaacggccgcatccgcgtccttaatattgttataagaaagctctttgccgtgaagctgttttgccgccgcgatggaaccggagacaggaagtgcgctttggtagaaaaccgcctcttggtgagggttttcaccgtagcggagcgactgttttttctcaaaagtaacagtgaattgctcagggtctttctcaccggcctcgcgtgttaagtaatcagcgattaatgcgtcgtatgccgcggtatggcggaatactttggccgcaagctcgcgttttcttttgagcgaaacgccgccgtgttctttcatctcattgagcacggagctgtaatcggccggatctgtgatgaccgtcacatcctgatggtttttcgatgcggcgcgcagcatgccgggaccgccgatatcaatgttttctatcgcttcatcgtatgttacgtcttcttttgaaatcgtttctttaaacggataaaggttgacgaccacaaggtcaatcggtgcaatgccatgctcattgatctgcgccatatgctctttattgtctcttacggcaagcagaccgccgtgaatattaggatggagtgtttttaaccgtccgtccataatttcaggaaatccggtcacttctgaaatgccgatgacatccacaccgttttcctgaagaagtttttttgttcctccggtcgaaatgacttcggcgccgagctctgtcagttcctttacgaaaggtacgagatttgttttatcagaaacactgattagtgcgcgtttgattgtcatgccttttcacctctgttatttagtcccagcagccgtttcacaacactcggataccatttgtgctcaagctcgtgtattgtatgctctatgtcttcaagcgtatcgttttcctgtatttcgaatgctttttgcgcgataatcggtccggtgtccatgccttcgtcgacgtaatgaacggtaatgcccgccactttcacaccggcccgatacgcctgtccgacagcgtcaatcccagggaatgccggaagaagcgagggatgtatattaataatgcgtcctccgtatgcttcaagcagcgtatctccaatcagtctcatatagccggcgagaacgattaattccgctccgtgcaggcgcagctgttcaataatggcccgttcaaaggccgctttgttttcaaaagatgacggttcaaaggcgaatgacgggatatgtaaagcctccgccctttccgccgcctttgcctgaggcttatccgtcacgagaagcgagagctccgcatcccacttctcttctctcatgcgtttggcaatggcctcgaagttcgatccgtttcctgaagcaaataccgcaaactttttcatgaaagagccgcaccgccgaaagaaatgccttcgccccgcttgacccggccgatcagataagccttctcgccctgagcttcaagcgtgccgatgacgtctgtcaggttttcttccttaacggcaaggacaaaaccgatgcccatattaaagacattgaacatttcttcttctttcagcttgccgtgctcctgcagaaacggaaaaatcggcgggatcggccatgatccgtgatcaatttccgcgctcaatccgtccggcagcatccgcgggatattctcgatgaatcctccgcctgtcacatgcgccatgccgtccaccttaccgcttttcaccgccttgagcaccggcttcacatatattctcgtcggttccagcaattcttcgccgagaggacgcgcaaacggttcatagacagtatccaaatcaagtccgccgtcatcaagaagcacttttctcaccagggaaaatccgttgctgtgaaggccgcttgaagtaagtccgattaagagatgcccctcttcgatatgttcaccggtgacgatttcgtctttttccgcgacgccgactgaaaagcccgcaatatcgtattcatcagacgtatacagccccggcatttccgccgtctcaccgccgataagcgctgatcctgactgctcgcatccgtccgccacaccctgaacgatctgctcaattttcaccggatcagccttgccgaccgccaaataatcaaggaaaaacagcggctccgctccctgggcaagcacatcgtttacacacatcgcgaccgcatcgacgccgatcgtgtcatgcttatccattgaaaatgcgagtttcagtttggtgccgacaccgtctgttccggaaattaaaacaggcttttgatacggaagctctgacagatcaaacattccgccaaaaccgcccaggcttcccataacgccgagccttttcgtgcgctccacgtgttttttcattcgtttgacggcttcgtatccggcttcgatgtcaactccggcatttttataagcatcagacatccctatcactccttgtcaattcgtttctcctaaaaaggcagaaagagaaaggcagcctgaattcccgctgcctttatgtcattttcacattttattttgtcagcaccgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcggcaccgatgatctgacggatttcttccacggaatgagaagaagcgatcagctcctcatgggttgatgtgtcgataccgtagaagcacggatgagcgatcggcggtgaactgatcttgacgtgcacctctgtcgcccccgcttctctgagcattgtgacaatccggcggcttgtcgtcccgcgcacgatggaatcatcaaccatgacgacccgttttccttcgacaacaccgcggacggcggacagcttcattctgacgccttgctcacggagagcctgtgacggctggataaacgttctgccgacataacggtttttaatgagaccgagttcgtacgggatgcccgtcgcctcggcatagccgatggccgcagaaatactggaatcaggcacgcctgtgacgacatccgcttcaaccgcggactcccgggcaagcattttcccgaggtttttccgggcgctgtgcacgttaatgccgtcgatattgctgtcaggtcttgagaaataaatgtactccatgctgcagatggaacggttgatattcatggaaaaacgctctgatttcaagccttcatcgttgatgatcagcatttcgcccggctctacctcacgaaggtacgttgcgccgacaacatcaaatgcgcacgtttctgaagcgaccacataagcatcgcccatgatgccgattgacagcggtctgagtccgttcgggtcaagcgctacgatcatctctgtttcagtcatgattaaaaaggcataagcgcctttcagcatagatagcgaatttttgatttgatccttcagtgaaaagtgtccgctgcgtttaatcagatgagccagcacttccgtatcggaggaagtctgaaaaatgctcccttggttttcaagctgctgcttcagctgtgtggcgttgaccaagtttccgttatgggcgagcgcgaggctgccgttgttttgcgaacggaacaggagcggctgaacattttcatatccgcctcctccagccgttgcgtaacgaacatgcccgatcgcgccttttccctttactttgctgagctcgccgttttgaaatacttcagtgatcagcccttggcctttgtgcgccgtcagtttttcgccgtcagtcgcgacaattcccgcgccttcctgtcctctgtgctggaggctgtggagaccgtaatacgtaatttgcggggcttcttcatgtccccagatgccaaacacaccgcattcttcattcaggcctttgatttcagcaagcatggaatagctcctttccacgcgcgctcaagttctttcgtttgcgcgtgaaccaattgttgtccttcttggcttcggatcgtcagctgtccgtctcctgtcacttcaccgatatgaatggcatctgcggcagccgcttcaaacgccgcttggtgttcttttttgaccgaaacgacgaagcgtgattgagattcagagaataataatgccgcttccccttcaacagtcacgttggcgccaaggttttccgtcgtcatgacactttctgcaatcgctacgcctaagccgccttcagatacgtcatgcgcggattgaacgaagccttttttaatcgcgtcaagcaatgctttttggcgtgacagctctatatcaagatcgatttgcggcgctttgccgtaaatgcggccttctgtcattttttgcagttcgcttccggcaaactcaggttttgtttcgccgatcacgtatacaagatctcccgcttgtttgaaatgctgtgtcgtaatatgagcggtatcttcaattaagccgaccatgccgataacaggcgtcgggtagatggccgttccgttcgattcattataaagtgatacgttaccgccgatgacgggtgtgctgagaacgttgcacgcctcgctgatgccgtcggccgctttttcgatctgccagaaaatttcaggtttttccgggtttccgaaattcagattatccgtgaccgcaagcggttcggcgccggagcatacgatgttgcgcgccgcttcggcaacggcgatttttccgccttcttctggatcaagatataaataacgggcgttgcaatccgtcgtcatcgccagcgcttttttcgtgccgcggattctgagcactcccgcgtcagagcccggagcgaccaccgtatttgtgcgcaccatgtagtcatattgatcatacacccactctttgctggcaattgtcggctgctgcagcagggcaaaaagcgtctctgtcccatcttttactttaggcgcgggaacttctgtttcctgaaactcgcggtagtacgcgggttctgctgacggtttgtggtatacaggcgcttcttccgccagtgcgtcgaccggaagttcgcaaacaacctctccgttatggcggaggcggagcattttatcatccgtcacatgacctacggaaaccgcttcaaggtcatatttatcaaaaatatcgacaatttcctgttcacgtccgcgttcaatgacgagaagcatgcgttcctgagactcggaaagcatcatttcgtaagcggtcatacccgtttcccgctgcggaatgagatcaaggttcatttcaatgccggagccggctttgcttgccatttcagcactcgaacttgtcagaccggccgcccccatatcctgaatgccgactaaggcgtcgcattggatgacttcaaggcatgcttccaggagaagtttttccatgaaaggatcgccgacctgcaccgcggaacgtttttcttcagatgaatctgacatttcttctgatgcgaaagtagcgccgtgtatgccgtcgcggcccgttttagcgccgacgtacatgaccgtgttgccgacacctttcgcctggccttttttaatatctttatgatcaatcaagccgacgcacattgcattgacaagcggattgccctcatagcttgcgtcaaactgcacttctccgccgaccgtcgggatgccgatacagtttccgtatcccgcgattcccgccactacttcttcaaacaagtacttcacacgaggtgaagtgagctcaccaaatcgaagagagtttaatacagctatcggacgggcgcccattgagaaaacgtcacggatgatgccgcccactcccgtcgcagcaccttggtatggctcaatcgctgacgggtggttatgagattcaattttgaacacgaccgcctgattgtcaccgatgtcaacgattcccgcgccttctccgggaccctgcagcacgcgttcgccgctagtcgggaatttgcgtaaaaccggttttgagtttttatagctgcagtgctctgaccacatcacggaaaaaatcccgatttccgtgtagttcggcaatcttccaataatagattcaatgagtgcgaactcgtcatcactgacacccatttgctgatagagtttctcttcttttatttgttctttacttggttcaagcagtagcgacatgagtttccctccaatttttcacgatagaccggaacaatgtaagaccgtctgcgctgccgagcagttcatcgactgcgcgctcagggtgaggcatcatgcctaatacgttgcctttctcattcacgacgccggcaatgccgctgacgcttccgttaatatcgccgccgtatgtgaaggcgatttgattgttttcttttaatctttcaagcgtttcgtcatcacagtagaaattgccttcgccgtgggcaaccggaatcgtaatcgattgtcctttttcataggaagatgtgaataacgtatcgccgttctgtacgattaattcaacagggcggcagatgaactttaaatctttgttgcgtctcatggcgccgggcagaagtccgagctcctgcagaatctggaatccgttgcagactccgagaaccggttttccttcggcagccgcttttttcacggccggcatgatgtttgcaaatctggcgatggcgccgcatctcaagtagtcgccgtatgaaaacccgccggggatgagcacgccgtcaaatccgtcaaggcttgtttcctcgtgccagacatactcgacttcttcgccgagttcgtcctttacggcgtgaaacatatcaatatcacagttggagccgggtaacacaatcaccgcaaatttcactgtgcgacaacctcctcaacttcatatcggtagtcttcaatgactgtattggcaaggagcttttcacacatttctttcacgagcgcgtcaagatcgcggtcagatttttcgatcgtcagctccatgtattttccgatgcgcacatcctgcacttcattgtaggtcatgctgtgcaatgcatgctgcactgcgcttccttgaggatcgagcacactttcttttaagctgacataaactttcactttatacattatgaaatgcctcccagtcttttgaaaatctcttcatatgcgtcggttaagcttcccaggttccgtctgaacaaatctttatcgagcttttcgtttgtgtctttgtcccacagacggcacgtgtcaggagaaatttcatccgctaaaagcacccgtccctctgcgtctaagccgaattccagcttaaaatctattaatctgaccccgcagtcttcaaaaatgtgctgaagttcttgattcacctggtttgtaatcgatttgatcgtttcgacatgctcaggagccgccgcttttaagagccggatatgatcttctgtgatgagcggatcgccgagtgcgtcatccttgtagtaaaattcgataatcggctgcgggagctctgttccttccgggatgccgagacgtttcgacatgcttccggcggcaatgtttctgaccacgacttcaagcggaatgatgctcacttttttgatgagctgctctgattctgaaacacgctccacaaagtggttgtcaattcctttggcgtgcagatgtttgaaaatcaggcttgaaatttcattgttcagacggccctttccgctgatctccgcttttttctcaccgttaaaggctgttgcggaatccttgtagaccacgcggagaatatgttcgtcttcagtttgataaattcgtttcgcttttccttcataaagaagattattgttcacaatattcacggaaggcctcctaacccgaatgttgggaatattcaatctacggcggctgaagaagccgcctccggctggcttcttctataaacctaaacgctcaaagatcaagtcgacgtttttcagatgataattgtagtcaaagcaatcggcaatctgttccggtgtgaggcgggacgtgattttttcctccgcttcgacaagctggcggaacggcacttgtttttcccacgcttccatcgctttcggctgaaccgtgtcatatgcttcttcacgaggcagacccgtgtcgattaaagcgagcagcacgcgctgagaatagatcaaaccgagtgtgcggtccatgttgcgtttcatattttccgggaataccgttaagtttttgacgatattgctgaatcggttcagcatgtaattcagcgcgattgtcgcgtcaggaagaatgatgcgctcagctgatgaatgagaaatatcacgctcatgccataacggtacattttcgtatgccgtcagcatgtacccgcggatcacgcgcgccatgcctgtcatattttccgacccgatcggattccgtttatggggcatagccgatgagcctttttgtcctttagcaaaaaactcttccacttcacgtgtttcactcttttggagaccgcggatttccactgcgaatttttcaatgctcgtcgcgatcaaagccagtgccgccatgtaatccgcatgacggtcgcgctgtaatgtctgagtggaaatcggcgccgctttcaggccgagtttttcgcagacatactgctctacgaacggatcaatatttgcatatgtgccgaccgcgccggaaagcttcccgacttcgatcccttcttttgcctgcttgaaacgttcaaggttgcgtttcatttcttcgtgccaaagcgcgagcttcaggccgaaagtcgtcggttccgcgtgtacgccgtgcgtgcggcccatcatgaccgtgtatttatgttctttcgctttttcttttataatgtcaacaaatctctcaatgtccttgagcaagatctcattcgcctgttttaatagataggaaagagcggtatccacgacatctgttgacgtcaggccgtagtggacccattttctttcttcgcctaatgattctgaaaccgcgcgggtaaatgcaacgacgtcatggcgcgtatcctgctcgatttccaaaatccggttgatgtcaaaagacgcgttttcgcgcatgaccttgacgtcttctttcggaatgacgccaagctcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatgtttcatcaggcttccgcaaaaatgtcatatgtcccattttgcggcctttttttatctcatgttttccgtacaggtacagtttggcttcctttaaaagctccgtatgctcctccgcaagcttcacttcctcaccgagcagattcaccatcattcccggtttgagaagatcggttctgccgagaggaagtccgcagaccgctctgatgtgctgttcgaattggctcgtttcacaaaggtcgagcgtataatgcccggagttgtgaggacgcggcgccagttcattgatcaaaaggtctccgtcttctgtgacgaacatttccaccgcaagcggcccgacaagctccaatttctccgcgagctgaacggcaagcgcctctgcccgcttttgaaccgtttcctccgctctcgcgggcacgatgctttggaacagaatattatttttgtggatattttcagcagccggaaaggttgaaatctcaccgtgcaccgatctcgtcacgataacggaaagctccatccggaacgatacccagctttccagtatgcacgtgccgttttctagcagcgcggccgcttcgtctgtctgtccttcttccttaatgacaaattggcctttgccgtcatatccgccgcggcatgttttcagcaccgccgggagccccagtgcctgaacagcttcctcaagctcccgtccgctgtttacgatccgataaggagcgacttgacagcctgctgactgaatcgcctttttttccgtttccctgttttgggtgataagcagcagctcgcttccctggggaagatatgcatgttctttgagccagttgagcgcctcgtaatcgatattttcaaattcgtacgtaatgatgtcactgactccggccaatttttgaatcgcttcacggtcattatactgggcggtaatctcaatatcggcgatctgtccgcatggcgagtctttcacgggatcgacgactgcgactttatagcccatctgttttgcggcgacagccatcatttttccgagctgtccgcctccgataatgccgatgacggcgccgggataaatcgtttttttatcagacaagctgatcactgctttccagcaccgtttgttttgtcgcatttcttctcgcctctagtttatccgcaatgtcaccgtcaaatgccgacaaaatctgcgcggctaacagacccgcgttcactgcgcccgcttttccgatcgccgttgtcgcgaccggcacgccgccgggcatctgtacgatagacagaagagaatcaagcccgttaagcgattttgtctgaaccggtacgccgatcaccggcagtgtcgttttggccgccgtcatacccggcagatgcgccgctccaccggctccggcaataatgacttttaagcctctgtctctggcgctttctgcatattcaaacatcaaatcaggcgtccgatgcgcggatactacctgtttttcataaggaatgtgaagttcgtcaagtatgtcgcatgcatgtttcattgtctcccaatcggaggtgcttcccatgatgattcctgctagcggctgcattctgttcccaccttctcatgctttgtttttcagaaaaaaaagcccggcttatattgcaactatgaggaagcaatacaaaccgggcatggcgcgcgtatcgtcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttttcccgcaaggaacgacttgaattgatccattttctttcttttctgtaaagatgggctcttccatccgcctgacgggcatatacccctcttccttcattaaagtgagaatggtgtcaatcgtttcatgttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcatacagctgaagctcatatttgcgcggcgtcagaatctgcatggcggtccggtctccttcaagtccgcccgcaacccagcttgtaacaccgtatcctttttcccggagctgtttcggcaggtccagatcaagctccttcgtaatgacgttgactgttatgtagccgagcgccagtttttcttcaatcttcattcccactatgacgccgaggccgtagccgagcgcataggcaatgacgttttgaatttgattcagattgtcgagcacaagactcagaccggtcacatacacaaggatttcaattgtactgatgcctgcggcgaaatagcgctgtccctttaatgtcagaatcatcctgatcgtaaagaaagagacatatataatgttaatgatgagaataatgagaaccatacctatactgttggataaaattgtctgcatcactgattcccctcctctgactttgaaaagccaatctttcaattaaggatagtttaccctcttttcatcattttcaaaagaaaaaaaagcccgccccgcaaggcagactctcaagctcttatcagtgaagctcggcttttttcaatcgtttgacggcttcatattccttctcaagttcactcagcgtgtacccggacagttcctgaacatggtcttgataaaaccctgagcggatcagttttgtcctcaggtgctgttttttccgattaatggcttctcgcaacaacggggccatcttcatcatccctttccgaatcataaagagtagtgccgctttcgaattgctgttgctctcatcatatctcggccgggtcctcaaaacaacacgcttcattagaaaaatttgtaaaaattatgaaagacaaatttcgacttataaaggaatcagcgaagcagtaaagtactcggaaatgagcggccatgtcacagccgtaaaaacgagcataatgatgaccgccgcggaaatacagtacatcacgtcagccgcaggcttttcagccgatttgtatagaatctgcacaaactgcaccatcgccgaggcggccagaaacaaggtcagcgccgtaaacaccacggtgatgaccggcagattcaatatcgcgaaaatcatccacacgatagagcaggcgacagccggaaccaaaagcgatccgacccccgcggccgcatcccgcatcgtaattttctgcttcatcatataacgtgatacaagccagaccgcgccggccgcagcggcaaaaaagacgagcgtatacacgagaacgacggtaaagccgtcaaaaaacgtatgatgccgctccccgtatccgagaggcctttgctggcttgccctcagctgaaaccaatttccgattgagaaaaagatactgaatacaagcattgaaataagagcatatttaaagcgggaaaagccgtcttccccaacgaccttcaccggtgatgtcaaaatgcgcagcgcgaaacggcaataacgtttgaccgcggcccatgcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgtttagcaagaaaataaaacacttatataaggtaccgaagcggccttaaacagtcaagcggttttcttcacccagacacccacatgacgttttatattatgtattggttttacggaataggacaaaaacaaaaaaccggctttcctcagccggtttttccgttatttcaagaagatgaaatacaggataaagatgacgaacagcccgtacataatcgggtgaacgctttttccttttcctttgcagatcattgtaatcgggtagaaaataaaaccgatcgcaatccccgtcgcaatactgtacgtcagcggcatcataatcatcgttaaaaatgccggaacagccacctcgaatttatcccaggcgatcttaccgagcggcgccaccatcagcgcgccgacgataattaaagccggagccgtcacattcgtggtgacaactgacagaagcggcgagaaaaacatcgccagcaaaaagagaatgcccgtcacaacagccgcgaagccggagcgcgcccccgccgcaacgcctgagctggattcaacataagaagtcgttgtagacgtaccgagcacggctccgataacgattgatgttgaatccgccaaaagcgctcttcccgcacgcggaagtttgttttccttcatcagcccggcctgtgtcgctacagctaccagcgtaccggccgtatcgaaaaatccgacgaacaggaaagttaaaatgacaatcagcatttgtacggagaagatatccggaaggtgcatccacgcctgtccgaaagtcggcgcaagactcggcacgctgccgacaatgtgtgtcggaaccggaatcagcccgcagatcataccggcaaccgccgtcaaaagcattccgataaacacgccgccgtttacgcgaagcaccatcagaatgaccgtcacaataacaccgaaaaccgtcagcagcacagggccgctgtgaatattgccgatagacaccaaagtcgatgagttcgcttcaataatgcccgaaccctgcaaaccgacaaatgtgataaacaaaccgatacccgcgccgaccgccaatttcagctcaggcggaatcgcattaatgattttttcccgcaatcccgtcagtgaaagcgccacgaagataattccggaaatcaagacgccggaaagcgcagcctgccatgaaatccccatgccgagtacgacagagaaggcaaaaaacgcatttaatcccatacccggcgcaatcgcgatcggatactttgcaataagccccattaaaatacagccggccgcagatgccaaggctgtagcggtgaacaccgcgccctgatcaatttttaatgcttcgggaaatcctttcacaccgtttaaagacaatgtcagcggattgacgaacagaatgtacgccattgacaaaaaggtcgttaaaccgccgatgatttcattacgatagcttgtccccagctcatcaaactgaaaaaattgcttcaagccaattgcctccttcattctctcccatttattctgcccgttatccgccaaataaaaaacgccccaaatacatttgggacgcttgactacatacgttcagtctgaataaataagaatggattatttatatcaaacgattgagattgatccgtagtcaagccatttacggtagcttggtagaaacttgcgggccatatccccgccattatacgatatctgcatatttgatttctgagtctattgtatcaattcaattttgaaaactcaataaaaaaacgaacaatcccgttaaaaaaaattggtttattcgttaattgaccaaaaatggaagacggcaagggccgccttcccggcatcattttccgtccgcaggccgaaccggcaccgtgaatgtgatccccttgtcatccgccagcaagttcataaccgtttgattgacgtacaaagcatatgaatcgaatgagaaatcgcgcaatgaatagtctttatcggatgaatcatctaattcaaaaacggattccatttcaccctttttaagattcgtgactttcgccttattccctttcagataatagcctttttcatactcattaagcgatggccaagttttcatttttttcgtattgccgagaccgattgattcaccgacattcatcagctgatcttcatccgccttgcttacatcaattccgctgaattgataatcgacaattacccgtctgtcttgctgtttgatctttttgatggtaatgccgacatgatgatgtttcgttttataactgacgggcagttttgttttcagaggcacgatttctcccggctctgattctgtttttatatcgcccgttatgaaaagtgttttcgctttcgggtctatcggtttgctgaattgagtttggccgcgtattcttttcccgccgccgggaagattcttcctgccgccaagttcaatattcgacatcgtcatttcataatggtttccagcatcatccgttgcttcgtcaatcgagatggcatcatttttggctgcatcatagaagtcgatagaatacaggagggccgatcccatcgttccgttttccgcccggatatcgaaaaagcggtataatccgtgatttacattcacagctttcgttccttcaagagaaacggacttttgttttttaatagggagtgtaaagcgccagtttccggggatatccttgatttgtgtaatgacaagcggaagcttatcaccgtctttcagctttgagccgtccgtgaacaggcgaagctgccccgcgtaccgcccgtctttcatttttttcatatcactgctgtcataatcctctgctaacatattccgtggatctttataatcgacttgaaaagagatgctctcctcatctgatttcaaattatcaacgataaagttataaacgagctgtccgctgtcgtaatacacacttttcactgtcaccgtgattccgcgtgattccgctttttcgttcagttttgtcaccaaattgcttttaaacagcgcagagcctgccttatcctgaaacagactgtaaatttgtccggcaacaggaatgtttcccatagccgtgttaacggagggcatgaacaagcctgaggacagatacagaataaacaaagcagcagcaaccgcgaggccgtttatcacttttcgtccccatctccgtctgacggcgccttcttttccggcacggacagcagcgctgtgtatcacgtttttcaattcagctttcggcacgtcaatgtcctgatacaattgcttcatttgatgcttttccatatgtgtttatcctccttttccagctcctgcttcaatgcttttctcgccctgtgcagatgcgttttcacagtgccttccgccataccggtctgttcagcgatcataccaatcgagaaatcttgaaaataataaagctgaatggtcagctgtatatgttcatcaagcgtttccagagcattccgaagatctatgtattcttcaatgttcttattctccgcgcgcgtatcgtgctgcggctcaaacggaatgacgtctccgtgctttttcctcatcgcaaaaatcgtatgtagcagaatccggatcagccacgttttaaaatatttcggctccttcagctgtgcgatatgaagaaaagccttgtaagccgtttcctgaacagcgtccagtgtatcttccttgtgatgcaaataaagataagctgttttatataaagtctcctgatgagttgtgatcagtttttcaaaggctgcggcatcaccttttttcgcctttttgatcaatcgttcttccttcaccttatccacctcctatgctgttagatatgaatcggggcaaaacggtttcaaaaagatgaaaaaaaaaacgcctcttttttaaaagagacgttttttatcttcatttattcccactcaatcgttgcaggcggcttgctcgtaatgtcatacacgacgcggttgatgtgtttcacttcgttgacgatccgtgttgaaatcacttcaagcacatcccaagggatacgcgcccagtcagatgtcatgccgtcaattgatgttacggcacggataccgattgtgtaatcatacgttctcgcatctcccatgacgccgacgctgcggatgtcaggaagaaccgtgaagtactgccagatgtcgcgctcaaggccgtggttcgccacttcttcacgcagaatcgcgtctgattcacgaacgatctcaagtttttcttccgttacttcaccgagtacgcggatgccaagtccagggcccgggaacggctgacgccatacgatatcatccggaaggccgagctctgtgccaagcgcgcgcacttcgtctttgaaaagggtgttcagcggctcgatcagttcaaactgcatatcttcaggaagtccgccgacattgtgatgcgatttgatcgtttgcgccgttgcagtaccgctctcgataatatccgtgtaaagcgttccttgcgcaaggtaatcgatgcctttcagcttgtccgcttcatcatcaaatacgtaaatgaattcgttgccgatgattttgcgtttttgctcaggatcagaaacacctttcagcttgtttaagaatctgtctttcgcatcaactttaatgacattcatattaaagccttcgctgaacgttttcatgacgccttcagcttcgcctttacgaagcaggccgtgatcgacgaaaatacaagtcagctggtcgccgatcgctttatgaattaaagcggccacaacagaggaatcaacaccgccgcttagcgcgcaaagaacctgcttgtctccgactgtttcgcggattttttgcatttcgatttcaataaagttttccattgaccattcgcctttacattcacaaggcccgaagacaaagtttttcagaaggtcatttccgtattctgaatgacggacttccggatggaactgcacaccgtaccattttttgtcttttttgctcatcgccgagttcgggcagtgatggctcgtcgcgtctaccgtaaatccttccggcacttgtacgactaagtcgccgtggctcatccagacaacttgttcttccggaagatccttgaacaagtcaggagttccttgaatctgaatgttcgcttttccgtattcgcgctggcttgccgcctcgactttccctccgaggtaatgagtcatcagctgcatgccgtagcagatgcccaatacaggaatatcgagttcaaagattttttcatcacagcggaaagatccttcatcatatacactgttcggtccgcctgaaaggataattccttttggattcatttctttgatttcctcagctgtcaacgtatggggatgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacacacgttcagtcctctgtcggcaagacttgtccggaagcccggctttttaacgctcccgggctcccatttaacattcatatattctaacaacaggacgatatgcggtcaagactatcttcttttaattatattttcccacaactgtcccgattcattccaaagctttgcggcattatcgctgcggtataaagcacgctcatagcgcagcgtcagctcggacatgtcgtttgtatggtgcgcctcatcaacccttgcggcaaaatcgcggagcgtttctccgtctcccctgctgaacccttttcgtttcagctggcggagcagcgcggcatatgcgtcgaaaaagacgtcttcatccgttcgccgcttcaatctggctgctgtaacgtgcggaatccagcgcgcccggaacagccaggcgagtgccgccgcggctgaaattacgatgacgatggctgcatacggccacaggtgtgccgcggttttgttgcggatcacaggctgcggtgccgcgctgtgatcccgctttttcggtgtttcttctttttccggctttgtttcctgacgctgcttgtcagacggtgaatccgaattccccgctgagcctccgctgtcttttgccgcggtatgattttgctctgacgtaaactccgtcggattggtgaagccttttgtcggctcaaacgtcacccagccctgatcgggaaaatacacttctacccacgaatgggcgttgttgtttgtgacttcataaatgtggccgttatggtcgcctgcccctttatattcaccggatgtatagcccttcacccaacgggcgggaattcccgcagagcggagcagcacggccattgccgatgaaaagttatcacaatatcctcttttcgtttcaaacagaaattgatcgacataatcctgattgtgctccggaaccgcgacatcctgtgtattatacgaaaatgcggaagatccgagataatcctcgatcgccttcgctttatcgaacatattatgatgattccgcgtcagtctgtccgcaagctgtcgcactcttttcggaaggctgtcggggacctgtaaataccggtcattgaattgattctgctcacggtatcgtttcactttcacttttctgagatcattcagcttaaagacgggcgcctgaaaagtcaccgtgtaccgtcccatattgcggatgttgcccacttgttcactgaccggcgtaatttgctcggtgtttccgttcatttcaagctgaatcgagtgcttcggtttaatattggagacgccgatcggatacatgacgtgattatagagataattctcatcaatggacacctgtgccgtataccgtctcgtctgcacactccggtcaaaccatatatcttccacattgccgctattcagtttataggacatgccctgatcggtctccacccagcctttccccgtgtatgtatctttcgtttccacccggaagtacgcccgttcttttcccttccatgtaaaaaccggcgtatcatcctcctgaaaaggaccgcccaatgtttcatcatgattgccgtagccgattttgctttcggcggcgggcacttctttgtggtttgtgatcttttttagaaacggcacgggatccggccagttcgggtctgatttcggagccgccagaccgaacacgacggaagcgcagataaacagcatcagcggcagaaaccatttgagtatcaatctttttttaaacgctatgtgttccgtaagccggatgcgctccatatacaaaagccccatcatcaaaaagccgataaagacgatccggatgacggcgtacgcggcatcataaggagtaaacgtatcaagcacggtgatatacgccaccgtcatgataaaaaagaataatattttccgctgatagatcacccagtaatgcagcaaatacacgagcagccataaaagcacaaaaaacagcaacgtgcggaatgacggattcatatcattccatcttccggtcccgatgtggcgggcattttgcatcacgtcccgcaaaaaagaaacgagccattccggctgaaaaatagaacctttataaaacaggatgtgaatactgatcaacgtaaacagaatgcaggacggcacggtgacgtaccacctcatccggaagaatgacagcagaaatgccaaaccgataaaaacgatgaaaaaaccggtatgttttgtatccgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttaatatttttctgagcgaagatgagagcgagtttccgttctttctccgaaagcgcggcattcgtttctttcgccaaaaacaccgtcatgtcagcacggccgggctcagcctgtttgagaaggtcttctgtaagactgcccgtcacgacgacaatggaagctttacccagttctttccctaaacgcccgcctgcatcggcttcttccgactctgaagctgatgccaggtaacgcagcatctgtctgaaatgccgctctccctcccggacgggaaatacagtccggtcgctccccaatgaaataaatcctgcgggagagcccttcacaagcgccgtgtaaagcagggatgccgaagctgacaccgcggcttcaaacgaaggggacggcctgcagtccaaaaggagaatcatattcatactctgcagcgggtcaaattccttcgtcatcagctcatttcgacgcgccgatgttttccagtcaagtgcggaaaaccggtcgcccggctgataatttctgacgctcgcagccattgctgtgcggtgtacctgaaacggagcaccggcacccgcaccctcttctccggatgcagcctgcggcttatagtgaacaggcccgtacgccgggaaaaccagaaccgtatccgttacggaaaacgacgccgtcttgtccaaaagcccgagaacatctcccgtccgcactctgatcgtatgtaaatgatgctctccgcgcggcacctgcggcagctcatattgtaacgtcagcttcctttgaaaccacggaaacacaagctgtttcgcactgcgcctctcgccaagcgtttccggcatcacatcttcaatgaccatatatgtcagcggaaacggcaggcgcctcatcagcctgatggtgacagacagcctgtcgcctgaggttaactgggcggaggacacgtcacgcgccacctgaaacgcccgcagcgggtacacagcgaccagcccggcgtaaacggtaaacggcaaaaacgcataaaataaaaaccagctcacaaatccgccctgaaacatggcataagaaaagacagccgccgtcagtacggccaacataagcagcttccagccatatagaagccaatgcatcttctttctcattagcggaccgacatcctttgaacgggaactttttccgtttgcatgatgtcttctataaccgcttccgccgtcacatcgttaaatttcgcctcggcggtcaagatcattctgtgcggcagcgtatacggagctaaatactggacgtcatcaggaatgacgtaatcgcggtcatgaagcagcgcgtacgcctgcgcggctttcattattgaaattgaaccgcgcgggctgacgcccagatgtacggacggatgccggcgggtatgctgaatgatgccgacgatgtacgctttaattccatcatccacccgcacctgctccagtttttgctggagggtgatgaactgttctttagaaatgacgggctcgattgtttcaagcggattgcgcccttcctgcaaagacagaacccgaagctcctcctcggcagtcgggtagcccatgcgcagcttaaataaaaaccggtcaagctgggcttcgggaagcggatacgttccttcatattcaaccgggttttgtgtggccatgacgaaaaacggctcagccagccgcattgtctttccgtcaatcgtgacattcccttcctccatcgcctcaagcagggaagactgcgttttcggagaggttctgttaatttcatcagccagcacgatattccccatgatcggtcccgggcggtattcaaattccattgttttcgtattataaatagagacacccgtcacatctgacggcagaagatccggcgtgaactgaatcctcttaaagtcagctccgatcagcttggccaaagcccggaccatcatcgtttttccgactcccggcacgtcttccagcagcacatgcccttttgcgagaatggcggccagactgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtccaaaaaaggaaaaaagctccctttagaaaggaagctttatttcagctggagaggctccatatgaacgtgtgaatggtcaatggcatattcctctttcatcccggcactactgctgtacggatgagaaaaaaatgtcatattttcttacatcattttcaactgtctgtggcatttatgatagaataatacttgtcggaatattcagcataaacaaaccaaaaggaggcaaagaatgaatcagcctaactctttatctaagggattaaaaacccggcatatgaccatgatttcaattgccggcgtgatcggcgccggattatttgtcggaagcggatcagtcattcattccaccggacccggagcgattgtctcctacgctttagcaggattattagtgatttttattatgagaatgctgggggaaatgtcctccgtcaacccgacaagcggttcgttttcacagtacgcgcatgacgccatcggtccttgggccggttttacgatcggatggctgtattggtttttctgggtcatcgtcattgccattgaagccattgcaggcgccggaatcatacagtactggttcccgggcattccgttatggctgacgagtctgcttctgaccgtgctgttaacactgacgaatatttattcagttaaatcgttcggcgaatttgaatactggctttccttagtgaaggtagcgacgatcgttgtcttcttaatcgcgggatttgcgttcattttcggaatcgttcccggcagcaagccggtcgggctggaaaatctggcgggcagcggcggatttttccctaaaggtccaagttccgttctgctcggcatcgtcgttgtcattttttctttcatgggatctgaaatcgtcgcaatcgcagcgggagaaacgtcaaatccggtcgaatccgtcacaaaggcgacccgctcagtcgtttggcggatcattattttttacgtcggctccattgcggttgtggtcacactgctgccatgggattcagccaatattttggaaagccccttcgttgccgttttgagccatatcggggttcccgcagccgctcaaatcatgaatttcatcgtcctgacagccgttctgtcctgcctgaactccgggctttatacgacgtcacggatgctgtattcactggcagagcgaaatgaagcgccgcggcgttttatgaaactgagtaaaagaggcgtaccggttcaagccattatcgccggcacctttttctcctacattgccgttgttatgaactacttttctccagactccgtatttttgttcctggtcaattcatcaggggcgatcgcactgctcgtctatctcgtcatcgccgtctcacatctgagaatgagaaagaaaatcgaacggacaaaccctgaatctcttaaaatcaaaatgtggttctatccgtacttaacctacctgacgatcatcgccatttgcgccatcttgttatctatgctgtttatcagttcaatgcggtctgaatttctgctgacaggatttattactctgctggtacttgcctcatatgtattccgcaaaaaacaaaaaccgaaagagagcgcttccgaaagccgtgttgcgcaataaccgcaaacacccccctctcaaaaaagggcgggtgtttttttaaccaacctgttccaggcagcattaactgtagtacaggatttcaataaatgataaggacaggatgaaaaatggcactagaaaaatttgcagatgaactgccgattatcgaaacactccagccgcagaagaaatcagacggcagcacgtattatgaagtcaccatgaaggaatgctttcacaagctgcaccgcgatctcccgccgacccggctttgggggtataacggtttgtttcccggcccgacgatcgacgtgaacaaagatgaaaacgtctatattaaatggatgaatgacctgccggataagcactttctgcccgtggatcataccattcaccattcagaaagcggccatcaggaacccgatgtcaaaaccgtcgtccatttacacggaggagcaacgccgccggacagcgacggctacccggaagcctggttcacaaaggattttaaggaaacgggtccttattttgagaaagaggtataccattatccaaacaaacagcgcggggctctgttatggtatcacgatcacgccatggcgattacgaggctcaatgtgtacgccgggcttgccgggatgtatatcatccgcgagcgaaaagaaaagcagctgaagcttccctccggagagtacgacgtaccgcttatgattttggaccgcacgttaaatgacgacggttccttgtcttatccaagcggacctgctaatccttccgaaacgctgcccgacccttccatcgtcccgtttttttgcggaaataccattctcgtcaatggtaaagcgtggccgtatatggaagttgaaccgcggacatatcgtttccgcatccttaatgcctccaatacgagaacattttctctctcgctcaataacggcgggaagtttatccaaatcggttctgacggcggactgcttccccgctctgtcaaaacacaatctatcagcttagccccggccgagcggtatgatgtgctcatcgatttctccgcctttgacggagaacatatcattttaacgaacggcaccggctgcgggggcgacgtcgatccggatacagacgccaatgtgatgcaattccgcgtcacaaaaccgctgaagggagaagacacaagccggaagcctaaatatctttcaacaatgcctaatgtaacatcaaaaagaatacacaacatcaggacacttaaactcacaaatacgcaagacaaatacggccggcccgttttgacgctgaataacaagcgatggcatgatcctgtgacagaagcgccgaagctcggcgcaacggaaatctggtcgattatcaatccgatggggggaacccatccgatacacctgcaccttgtttccttccaaatccttgaccggcgtccctttgacttagagcgttataacaaattcggcgacattgtgtatacaggccccgccgtcccgcctcctccaagtgaaaaaggctggaaagacaccgtgcaggcgcactcgggggaagtcatcagaatcgcggcgactttcgctccttacagcggacgctacgtatggcactgtcatattttagagcacgaagattacgacatgatgagaccgatggacgtcacggataagcagtaaacaaacatccccccctttctccagaaggggctttttttatttatccaaaaagaaaaaataagaaggcgcttttttgcatatactgtaataacaggaagacgatgcaccctcattggaaatctggatagaaaaaggaattaggagattagggaaaagtatgagacaatgaaggagtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtaaatctccaaaacaataatcaaacggcatcaagttagacctcccttttacgagtctcaacatagagaaggcctccatgtctcatgagaggcctttgcgttatcatgtccttttatgatgcaaaggagcaatgaacatgaaaaacgatcggcagcagaaagatctgaaggaaatggcaaaacggcggaaaatgaaccttgccgcacagtcattcatcgaaacgcttcattttgccgttccgattctccgttttttcaaatggctcgcctcagccgcagccagctttgttcattaaaaaacacccagcgggcgctgagtgtttttttcatgattggatgacggaaaaactattgataatgccgtggtcattttcccagactttttcgcattttttcgtatccaaatgataagcataaatggtccggaccttcgcattccgccccgtttcatccttcagtcgcttagcgccttttgcttccgccatgaaataaatgatgctgccgtctttagaaaactgaggctgggcatcaatcagcggagcgaagtccttcccgtttgagataatcgtttcatcttttttcgttttgacattcatcagacggatggatgctttttgttccgtccctttttgtgtataagatgtaaagacaaggttctttccgtccggtgacaccgccacgccgctgataaactgttcaaggtttgtcaggtcctgaaggtgttcgccagctcctgctgcaaaccggatattcgtcggttcagggtcaatccccttctcatttgcctcatccgttttttgataatcctctttgacggaataatgcagaagcgcaaaatcgttttggctgcggttataaaagaagctgcttacactgtcgtctttctcatcggcggcaggatacagattttcataacgtttcgttttcaaatcaaaagatgcgagacggaaaatatcttcatccgcttttccgagacggaaataaatgtgcgtcagatcctttgataaaaacagactgtcagcgcttgccgttcctttataaagcaccgtcttctttttcgtcttcagatcaagcttatacagacgcatctcattttggtcattattcccgacaaaatagagcacctgatgggcgtcatccagcgcaaatgccggatatgccgaaagcttttcctcgtacagcacgcggtcgtcctcgtaatatttcgtcatcagatctttgtctgtaatggaaacaagcagcttgtcatggccgccggagacaacggcttttccgccgccgtcgctttttcctttgatcagtaaaacggacgcgatgactgccgccgccaaaacagcggccagcaacatccagatccatcgtttctttttcattatcaatctctccgtcaatcagaaaaagcaagaatcagagtccttgctttttaagatggtctattttaatagctgtagtgtccggatactcttcctttgcttaacggatatccgagcgctttgaacgctttcgggctgacatccaatacggcattcggcagacggcctacatcatttttgtatactgtgataacctttttcggttttgctttcgcataagctctgattttcgttccgtttctcggaacgtcaaatcctaattttgtcgcgcaatcccagtgtcccagttttttaccggaagatccttttttaccgactccattataccatgtaatatttccgttcacttttttagcacttgcatcagaagagaaactgatcgctcccagcgtgcttcctgctaaaatcaataaggctaagaataacttcttcaagctttcgtcctcctgattctttattctaggcaaaattatacaccaagaagacgattataatatttcaatcactttacatgttcattacaacgtgatgagacatgcacataacgacggcacaattacctgttctatataattccatggtaaattatactacaaaatttaattcattagcgttataatattcatagagtatttctgcattcaatatggactttttataaggcctattgatagttgcataatatgatatattttgagaaatcaggctttaggaagcactttattccttttaaccgtggttcatattgatcatgtacctatactcgtttcaatcagactaggagtgataatcaatgaaagcggcaagatggcacaatcaaaaagacattcgaatcgaaaacattgatgaacctaaagcagaaccgggtaaagtcaaaattaaagtcaaatggtgcgggatttgcggaagcgaccttcatgaatatttgggaggcccgatctttattccggtcggcgaacctcatccgttaacaaacgaaatggcgcccgtcacgatgggtcacgaattctcaggagaagtcgtggaagtgggcgaaggcgtcaaaaattacagcgtcggcgaccgtgtcgtcgtggaaccgatttttgccacacacggacatcagggagcctataaccttgatgaacaaatgggattcttaggcttagccggaggcggcggcggattttctgaatatgtatccgttgacgaagaattgctgtttaagcttcctgaagagctttcttacgaacagggcgcgcttgttgagccgtcagcggtagcgctttacgccgtccgccaaagcaaattaaaagcgggcgacaaggcggcagtttttggctgcggaccgatcgggctgcttgtgattgaagccctgaaagcggccggcgccacagatatttacgcggttgaactttcaccggaacgtcaggaaaaagcgaaagaactcggcgctatcatcattgatccgtcaaaaacggacgatgtcgttgaagaaatcgctaaacgcacaaacggcggcgttgatgtttcttatgaagtaacgggcgttcctgtcgttctccgccaggcgatccagtcaacaaacattgccggtgaaacggttatcgtcagcatctgggaaaaaggagcggaaattcatccgaacgatatcgtcatcaaagaacggaccgtaaaagggattatcggataccgtgacatcttcccttccgttcttgcactgatgaaagagggctacttctcagcagataagctcgtcacgaaaaaaatcgtgctcgacgatctgattgaagaaggcttcggcgctttaatcaaagagaaaaaccaagtgaaaatcttagtcaaaccgaactaaaccgttcagctgaatatcagacacatccgaaaaagagccgttccggctctttttttcatctcatcgtctttccttccttttccttttaaaaatgatcccctctgcgcaaactatttttcaccctgtcccgtctatccttaggcagcagcctatgatacgtattttttaaaaaggagccctttgaagcaatgaagaacgaaacagccaaagcgtcgcttgtgacgtgcataactgagcgcaaggaagacttttaccggcttgcgtacagttacgtaaaaaacaaggatgacgcgttagatattgttcaggaatcaattcaaaaagcgctgacatcggtcgaatccgtcaaaaaccccgatgtgatcaaaagctggttttataaaattttagtgcgcacggccattgattttctccgcaaacagaaaaaactgaaagtgatggatgatgaaacgatcgagtttttaagccgaggaaaggaagatcactacaaggacacagaccttcacgaagcgcttgatgacctgccgcatcaatataaaaccattatcattctgcgtttctttgaagacctgaaattagaagaaatcgcggacatcacgggggaaaacatcaacaccgtcaaaacacgcctttacagggggctgaagctcatgcgcattcagctgacgaaggaggatctttcttaatggaaaagagattagaacaattaagagaagagtataaaagtgtgcccattcctaaggaactggacagcattgtcgaaaaagcccttcagcaaaaaccgaagaaaaaacgaatcgtgatgtggccgacatccgcggcagtcgctgcggccgtcttatttaccgccgttgtcaatatcaacccggatgccgcacaagccatgtctaaaatccccgtcatcggcaaagtcgtccaagccatcacattcacggagatgaaggaagaaaagaaccaatcaagcattgatgtgaaaacgcccgctctgtccggactttccgatcataaactcgaagacagcatcaaccggcattatatgaaagaaagcaaagagctgtatcaggaatttatgaaggcgacctcaaaaagcaaaaaagaccacctcagtatttacagcgattatgaaaccgttactgacacagcggatctgatctcaatccgccgtgatatcgaaaaaacgcaagcttcatcttatacgcaaagccgttacatcacgattgataaaaagaatgaggccgtgcttacgttaaagagtttatttaaagatgaccgttatattaaagtcatcagcgaaaatattaaagaacaaatgaaaaaacagatgaaagaagatccgaataaaatatactgggtcgaagaagatgatatgacggagccttttaaagccatccgcgccgaccagaatttttatattacagataagcataaacttgttatttcatttgatgaatacgaagcggcacccggatatatgggcgttacagagtttacaataccgacctccgtcatctccaagctgcttgtcggagaccgctacatcagataaagaaagaaaaaaatccatgatatccgcagatcatggattttttctttcgtcccgcaacagccaagatgcataagggacccttttcatataacagacgccggacggggactgaaatgtttaagaaaatcacagcatttcatacattttttctgaaacaaaatccccttccgaatgcgtctaattaacggaacaaatggaagactgtacagaaatcagctatagctatccgcaaaacagcgagaatttccgcacacattattggaggaataccatgtcagacaagtcactgcatcaccgctatattcccggactggatggacttcgcgcctttgccgtcctcgcagttatcgcatatcatctgaattttaactgggccgacggcggtttcattggtgttgatatcttttttgttttatcgggatatttaattacatctattatattgcctgcccaaggcaatgccatcacccttgatttgcgtgatttttgggtgcgacggatcagacggcttctgccggcggcttatctcatgattatcacgacggtcatttgggtcgtattgtttaacagcgagctcctgcataccgtacgcggagatgcggtctcctcacttttttacataagcaattggtggtttatctttcatcaactttcttatttcgacagcttcggctccccttcgccattaaaaaacctttggtcgctggcgattgaagaacagttttatatcatatggcccttcctgctgcttgcgggaatgtacatatgtaaaacacgggcccggcttgcggccgcggtcatgttcctcgcgttatgttcggcagtcgtaatgagtatgttgtatgtgcccggcggagatccgagccgcgtctattacgggacggatacccggtcatttgaattgctgatcggctgcgctttagctttagtgtggccgatgaaacgattatcttccaaacggctgccgagcagcatgaaacacctgcttcacgggacggagcttgccgcttttgccgcgctgctgctttgcgtcttttacacggatgaatatgaacccttcctgtacaagggcggcatgcttttgatcagcatcaccgcagcggttcttgtcgcatgtttatgccatcccagcagctttttgggacatgttctttcatggaaaccgcttcgctggatcggaacgagatcatacggaatctacctttggcattacccggttttcgtactgagcacacccatgcaggaaatcggaaatccggtttattggcactgcgccgtcagaatcggcgccactttcattctcgccgagctatcttaccatttcattgaacagccgatccgcactgcgggcttccggccatttttacgccgcgtgtttctgaaccgctttctggaatggaagacgtcctctgtcatcagcagaatgtcgctcggtctcattcttgccgccattctcgtatttgcgggcgggctgtcagggatagccgaagagaaaaaacagccgcaatggacgtacgcgcagaatgatcagcaagaaaccgccgcctcttcgcacaaaacggccgatcacgatcagcctgcaaaagaagaagacagcaagaaaaaacacggcggcgaaaaaacggataccgcgtcagacaaaaacaagaaagaaccagcagacaaatcagaaacgaagaaaaccgacgagaaaaaggaacggtcatctcaaaaaacggctgattcaaaacaaacacagcctcagcaagacgtgctggccatcggtgactcggtgatgctggacattgcgtcatacctgcggcagtccctccctcatgtcaccatcgacggaaaggtaggaagacaagtctctcaagcactccagctcacttcggaatatgcgtcatttaatcagccgaacaaagcggtcatcatcgagttagggacgaatggctatttcacaaacagccaaattgaatcactgatcagctccttttcaaaagccgatatctatcttgtcaacacgcgtgtaccgcggcagtgggaaagcaaagtaaacgaatcattgcgccggcaggccgagtcacgcaaaaatgtgacccttgtcgattggcacgcaaaagcattgcagcaccctgaatacttcacaccggacggcgtccatctcatacctgagggatcaaaagcgctgacatccctcatcgttcaaacaatgaaatcatgacaaaaaaagaggcccaaaaaaggcctctttttcgtatatcgtcaggcaagcttctgtccgcaattcgggcaaaaattcgcgccttccgttttcgttccgcagttcggacagaatttcggcttagccgctccttccgagctgtttgccggcgccgtcccctgattctgctgactttgattttgctgcggctggttctgctgattttgattcatttggttcatcatttgatttgccacattcattcccatcatcatgcccgccatgtctgaggcggcgccgcttccgctcattttgccggatgacatgccgtccgtcatggaaatctgctgatagcggttcacatcccccaccatgccgtaagaagcgtttttcgtaatcatatcctgaacttcctgcggatagttaaagctcataatattgaatcccgtaatcgacatgccgtctccgatcagctgcatatcaagatcttcttgaatcccttttccgatttcaaatgaattcgactgcagattgaacatgtcttttccttctctggtgatccatttcatcaaaagctgatcgagaatagacgtaatccggattttaatgtcctccactaaatagctgtctttgacacccgcaatcttatcaatcaatccgatatagtcaatgaccttgaagttaaatgtgccgtttgcgcggatcggcataccgcccggcatacctgccgccggaatgttgatggcgttttttgtgccccacttcacggtgaactccttcgtattcacaaacagcacttccgcccgcatgccgctgttaaagccaaacttaaacccttttaatgtcgatagaaacggaatgatttctgattcgatatcataatcgccgtcatcacggaaaatcccttcaatcttcccgttgtataaaaagatggcatcctgtcccggccggatgatcagacggctgccttttttaatttcacggttgttccatttatagaaaaccatgtcgtctctgaattcttcccattccaccacatttgctaactgatttctgaaaaaacccatgtatgctcaaatcctttacatataatttaaaaacttcccttgcttccgctgtaactcgtgccgcccctcgtgactccgccgtcattgtcattatctttatctggctttttttctcttgtaatgtcggttcggatatatgtgtcgtgctggctcagcacttcagacgtatcgtgatccatatacgtgctgccggtgacggtgaccttgccgccggaattgtacaccatcacggtgacggcgattccggccgctgctgcagcgataatcagctgaaaccaccatgtgagcagcagattgtcagacttgtcgtccggacttttccccatatctttataagccatcttgatgtaagtctgaaacgccttttcataatggcctgcggaaatatctgacgagatcgtatttctgatcgtattcagccggctgctgttcaaatacgtctccgcctttttatatccggagagaaatacttcccgatccttcatatcaatagtcaatatcgccgtgcttccgctaaaatgactgtcataaaaatcaccggcatactgttcgatctccttaccgcccgttccgtttgcggtaagaatgataaaatcggtatggcgcttttctcccagcttcccggccaattcctcaagtttcttcgtttcatccttcgttaataaatgagcattgtcataaacatattgcttctgttccgcggcagacgccgatgtatgtaaagaaaaagacagcatcagaaaaaggacgaagcagaagagacacgctttttttatcgatactttcatcaaaaaccgcctcctatcataagtgagacgagtcttaatgctaaaaacgcaccggcggttatgccgccgaaccacgcggccacttttccggcactgatcggcggtttgccgacaaccttgcccgtctgcccgttcatcgcaaaaatgtgctcagcccgctcatagtcgtagctgaccatccagaccggaagcagtacgtaaaagctgctgattttatcggtctgaatctgctcatccgtaatgtcagccgtcgtatacccggagaaggtggatctgatataagaatcaatataatggctgattttatccttcgcccgcggaaagagatcgtcatcggtataattgtacttttccgctatatatcccgctaaataggccgtattaaactccttcagctcactgtatgagtaaggctccaatttgtccattaattcatcattcattttttctgaagcgtcgaccggaattttgagataatcaagattgatatcgcggtacgcgttgtaatactcggtctccgtcacccggtattctccatcttcatagtgatgcactctcgtacaaacggcattgacctgaaccttgctgtttaagtcaaacatccaaaacggcacgtacatgccggttatgctcttcacccgatcggcagtcataaatcctttcggtgtcagacggccgtttcggcaccactttttaaaagcgctcatggcttcttctttactgatcgtaaaaggaatcaccatcgaaggcgcgagatttcccgataatcggtcggcgagaacggcggctcctccgcaaaacccgcacgtcgtggccgtcgtttccgcctcagtcattaataccgcgccgcagttctcacagcggtactcgttcgcctcattttcggaaaatctcgttgttatatactcttttggcaggctttcaatctgatcctgccgcccgcagctgtgacatgtcagcatgccggatgaactgtcaaagaccatatcatcgccgcagttcgggcatttataagaaatgatcattctgtttctctcactttctctttatatcggacaaagctgcagcccgctgtctattgatctttactgaaaagcattttctgcttaagcgccgccaactcatcgtcgacactgctttgattgctgtcatatttagccgtcagctcgtcaatatcgtctttcggagacgcgttcagctcagccatcgcattggcgtgatcaagcgcccggttgaccttgtcttccattctgccgaaagctgtcagcgattggcccgcatttgacacagaggaccccaatttgttcattctctcctgtgtttttgccacagaccacttcgctttaatggcatttcttcgcgactcaagctctccgatatcagcgacaagcttgtcatgcattttgcgcatttgagacgcgttggaagaagcgagctgataagccgcttgcagctcagtcagtcttgattcaacagccgttttcctttccaaaaatgtccgcgcatcggcttcattgccggcctgcaacgctttcatcgcataactttccatcttttcggcatcagcctggcattctgttaatgctcttttcgcccgctgttcctcagccatgacagaagccgtctccgctttcacttttcctaaatcactgttcagattccgtaaatattgatcaaccattttttcagggttttcagctttatccagcagcgcattgatattgcttgacataatgtctttaaatcttcctaaaatactcatttttcattttcctcccaaaattaaatagtaacaagttcacagttatatatactgtttttttcgaaaaaggtttcattttctcttgaatttatgtatttttatatgaaaatagtctcattcagcccatttgtgccggcggaaattcttcacgagcagatacagtgagaacaaagaataaacaaacagcccgatcatcaacccgctcactaacggataatacttcgccgcatacacaaagaaatccagctgcgaaatctgttccggacttgtaatcgtatccgtcccattcaaaagctttgagaatttagccgtatcattccaatcaaacgaatcagaaacaagctcactcccctgataccaattgacagcggcgagacaaagaaaacaaaaaacagaaaacgcgcattgcacaataagaaaaacatgtttcataaaaaaattcctccgcggttcaatatcacaggccgtcacactgtacatgacggcagcagcagaaacttggttttactcagaactgataaaaacattattgtatgtacttcacagcggttcaatttactggatgcctttctaaagtataccgtatatcgaaaagggtttcagacctaaataaagaggatgcttcccgaagtccgatgactttcaagaaacatcctccatactttacagtgatacctcaacctcttttaagctcggcaaagcatcaatcgcaccaattttggtgcacacgagcgcccccgccttattggcaaatgagacaatatcacgcagcttcgcaaaatcttcggctgccgtctgaacctcatccgtgcgcgccagctgatacagcgccgcgccgacaaacgcatcgcccgctcccgttgagtctattgatgtcaccggaatgctcggaatgatgtcaatatccttcccatttgaaagaagggtcccgcttttccctagtgtcaccgccacaataccggccccaagctcatgaagaaccgcagcgccttctttatgatccttcgcaccgctgatgatctcaagctcttcgtcactgactttcacaaaatcacttacggcaatggctttttttgcggtgtttataaactctgaaactcttcctttccataaatcctcacggtagttaggatcgaaggaaataaactgtccattgtctttcgcaatcgacatcagccgtaaataggccgagcaaaacggatcagataacaatgccgtcgctgatccgaaatgaaggattttcgcatcgtttaccttttccagatcaatatcatcaagcgtaaacaaagcgtccgctcctctgttaaacacaaagtcgcgctccccgttttgttttaatgaaacaaacgcaagcgttgtaggcgctttctcatccatgacgagcatagaggtatcgacatgtacggcgtccaatgtctgcttcagaaagtacccgaacggatctttgcctgttttcccgctgaaagcggcgtctccgcccagcttagcaatggctgccgacacattcgccggtgcgccgccggcactttttaagaaattgcgcccttccgtcaaatcaacatccacatcggtacaaaagaaatcaattaacaattctccaatacaaataacagattgccttcccacattatcacactcatttatcaattctcgattatagtttcagtatagtgttttctgtcataaatacaaccgtttacatagaatattttaaattttacgtatacttatctggcagccctttgctccagatcagacatcatctgctgatattttttttcagttaaaggataaaaagaaataagaataatagacagcagaatgaacaatcccggaatgagcgcattcatatttttaatcgcattcaatgacgaggcggtctgatcggtattcgcggcatatccggcgattccgagataaacggccgaaaatgaccccgctaacgcaactccgagcttattgatgaaactcatgctcgaaatcaccacgccatcagcccggactccggttttccattccgcataatcgacacaatcagcaaccattccccaagcaagtgtatttaaaggcgtcgtgaaaaatcccgaaacgaaaagccaaaagaaaataaggggaatcgaggaatacgatgtaaactgaaggcccgcataagaaatcagcgataacgccgccgtgatgatcatgacctgcttccggccccgcttcttagaaaagaaaggaataaacagattgctgatcagcgctgcgccgaaaaacaacacggttcctaaaaacacaaattccttatggctgacgttatacgtaaaatagtacaccatcgtgctgagcttaatgttaaacccgatcgcaaaagctaaaaatgaagaaaccaaaatgagcaaaggcttgtttcggaacaaaacagacaacgtctttttcattccttgtttttttcttttttcaggctgaatccgttcccgcacggtaaagaagctgaacagattcaatgcgatgctcactaccgcatagataagcgccgtcatctggaatccgaacgcctgatctttcccgccgatggcgtccgcaagcggtgtcgcacaggaaatcgacaacagaattccgatataaaccaaaatcatccgggtcgtcgtcagaaccgtccgttcctccacggaattcgtcatccgacccgttaagctgttgaccggaatcgtctgcatgctgaaggacatcccaagcagaatataagtgatgtacgcataaaccatgttccccgtctcgccgaaatgaggcgtcgtaaagcataagaacgtaaataacgcaaaaggaaacgccacccacaaaagatacggccttgcctttccccatcttgtattcgtcttgtctagaatcacgcccataatcggatcaaaaatagcgtccagcacccttacgataagaaacaaagctgcgatgaccgcaggcttaatgccgccgacatctgtatagtagaataataagtatgcgtttacaaactgaaagataatattgtacgacatatcgccgaatccgtagccgatccgttccatccaggacaggccgcgatgtttcgtctttactgccgctgctttttctgtttcaatcatcatttcccaccccaagaatccgttttcattttcgataagcaagagggagaatgcaaagatcctccccgttcactcagcgatttggatacaccatcacttttaagcattcatttttgtattgaaaggcgcgttccatcgcctcttgcgtcttctccagcggatattggtccgttacaagatgcttcgtgtccactatgccggaagcgagaaattcaattcccttcggatacgtattcgcataacggaagattccgtatatatcaatctcgttatccgcaataaacggcacattgagcgggatctcgttctgagaaggcaaaccgacaatcgccagttttccgccccggcgcacggacgccagtgcggattgcaatgccgccggattccccgctgtttcccaggcagcatcaacgcctctgccattcgtgatcgttttgatttcttcaccggcatcctgttcccggacattgatgacatgcgtcgcgcccatttttttcgcggcatctaaccgcagcggctccaagtcggtcacaatgattgtgcctgccccgtatgctttcgctgccgcaacggccatcagccccacaggacccattcccatgatcgcaaccgttgaaccgggctgaagcttcgttctcgcggccgcatgaatgccgacagaaaacggttcgatcaaagccgcatcttcataggaaagtgaatccggaatcgaaaaaacaaagtcctgacgcattttgatatattggacaaacgcgccgtcaaccggcggtgtcgccaaaaactgtacatccgggcaaagattataacgcccttctttgcacgcttcacagcgcccgcatgtgacaccgggttcgacggcgacccggtctcctattttaaattgatcgacagacgatccgacggcggcaatttctcccgcgcattcatgaccgaggataaatggtttttccactacataattgcctattctgccatttgtatagtaatgcagatcagatccgcaaattccgacagccatcaccttaatcaacacttcatcatgattgatgtcaggcacgggcaatgtttcgattttgatttctctcgtgttgtgcataaccgccgctttcatgttttgaggcactgtgtgagtcatttggcaaaatcctttctctgctttgaaatgtaagtgcatacatttttgttttctctattacttctcctattttatctgcttttccatacgttcaacagcctttcctgctgtataaaaggacagccgcactgtactttttattttttcatatacaaaaaacactgaattgataaaatagtactaataggaggtgcaggctaatggctgaactagaaaaccggacacaatttgcagaactgctggcacctgccgtcaaatcgctgaaacttcatcctgattataaagtcagaaggaaaaataacgaaaaaacaggacagtcttatatcgatcaaatcgcactccgattaggcgtttcctctaacacgatcaaaagctggatcggacagatgggcgcaaactacattcccggacgaattgacgacggaaagctgttcggcatgatctggatcattatcgaaaagactgacatggatcctgaatggctgaccggccttctggaaaccaccaccattcccgtcatcaaacccgcattgcccgtttggacggcgtcttgtctaaaaaaagcaaaaatacgccggaaagacggatcattcggagcgccgactgatgaagatgttgaaaaagcagtaaagcggctgtttcatgacagacccggccatgaaacgaatgcgcttacagagcagcccgtcacgcataacttaccgtcacgccggaccgggaactttatcggacgcggctttgatataaaggcgatccggcaatggatgctgtctccgtcaccggtctgtttaatcacaggctgggccggcatgggaaaaacaacaatcgctcttgaagcagcctacctttgtgccggcggttcaccagattggcctgcattcaacagcatcatttggatcagcgctgactggaaaggattgagcttcagcgattttttaaacacgatcgcctatcagctcggacgcgcagaacaaatcgacaaatccatcaacgaaaaacggttcgtcgtccgcaatgcattagccgctcattcaaacgaaaaacccgtgctgctgatcgttgacagcattgatacagcggaacatgacattcacgaatttatcatcggtcttccggaaggcgtaaaagtcctccttacggcacgggaaaacgtaaaacagacataccgggacggcctcggggaactggcggccatccagctgagcggccttgagcaaacggatgcccttgaatttttccatcaagaagtgcaccgctgtctgcaaacatgcaacctcccgcaaaaacgggaaaagcttgagctgctgctgcggctatcgcctgaccttaagaatgaattcatctcggcagccgccggcaacccgaaggccatggcactgagcattgcatacatgtcagacgacgacatccccgctccccagctcatacaagagcttaaacaagcgggttactcattattggaattgtttgaagttctctttggccgcacatgggacagatgtcatgaagacacacggaaactatggcagacgctttgctttttcgctaagccccctgatgaaaaaagcttggctcaagcggccggattagacgtccggcggtttcattacgcgattgagcaaatgaggtcatatgctttaatacagccagaacgaagcgaaggaagaattcaatatgcagcccatcaaaccgttgtcgcttacggagaacagcacttatccgaaaatcacgaatttgcaaaagaagcccgcagccgctgggcgcattattatattgattatgcggaaacccatataaagcgggaacagcccaattctgtctattggagctacttgctgggacggaatttagagcaaatgaaaaaggaatggccgaacatcctaaaggtcatcgaatggtcgagtgaaaccggacaacatgacatcctgatcaaactcatcatccgcatcagccattttctaagcagaatcaacctgcccctgcgaatcgaatacggattaaaagcagccgatgccgcccgtcaatcaggcgaacacacgcgggaagcctacttcaggatcgacacggcaggctgggcgctgatggaagtcaacgattcagacggagccctcaggcaaatagaagccggcctgaagatactcgaacaatcaggcgcgccggatcacgacgacttgaaagtatggggaatcgccctgcaatcgaggctgctgttaaaaatcggagaaccggacaaagcggcagcaatgctggacggcatcaaagatcagcccgtctcccccattatccggcacagggttcttctggtccgcggcgacctgagtttcgcccgctctcactacgaagaagccatcacattatacgaagcggcaaacacaaccagcgccgcatacggcggcgaaaaaacgatagaagcctatttcaacctgggcatggcttacgtcaagtgtgatcaactcgaaaaagcggaaaaagcctttgaacaaatgctctatgacaaacataacgccaatcaggttgaactgatctactatcattacggaatggcacagctgttgtatcgtaaaggagaaaatacgaaagcgatggaatcgaatcaaaaggccattcgtctgattgattcgtgggagcctgggattgggattcggggtgaggtggagcagctgagaatggtgcttgaaggaaatgaggaaatcacattgtagttaggaaagtgtgaggtcaatcttagataaacccctcacaccttatttataaataaatcaggccttatcagttgagtaaactgataaggtcttttttgctagaatgcatgagcaatttagatgaaaatcaaatatccaacccttgatataacaaaggtttttgctgtttatttgcattattcctcctaacatcataaaaaattagtttttaataaatatttgaatcaatgtttaacaatctgtcaaaatgataaaaccagactagggctacactagaacttaaaggatatcaaactgtatgtgccctttaatgtttaaagctagcagtaagttgaatgatttccaactttgatatttcaagtgatattttatagcttattctcttccgctaagaattttttagaaaaagtggtaatatccccttgaaatttaattgattatagccgattatatataggtattatataaactgggggttttaggtgaagaagtgactctttttattcatgcctttagtactatccttagtttttagcgcgccttgtagtactcgacaaatgatgtctcacagggatagtgattcaaaaaataaaaaagcttgagagactaaagatgactgttctaaaaaagtagatgccagcaaacaatatgctgaagcactgggcatgagttaatctgggcgatataaagatcatgagagacaagataaacgtcggaataaacatcaaaaatacaactgacaaaacctgaccttttatcctgaccaaggaaatgccgttattggcaattagctgcaaacatgttcttaactgatggagaagtccaaggcggaataaaacaaaaggtgtatttgaattctctgctccagatgaaaaaaatgatgttgatagagtcaaaagaaattaaattgaaccttggaaatgttgtcacataaacttcatgaaaaataaagctgtatcaattacagtaccagttaagtaagggagagtgtaacaatgaaaagaacaactgaatttgttttaggattattgggtggaatttttggttttattggggcgatcatggcattgattattggtggacttgatgcctcttttaattcaagcggtacaagcgaaatcattggtttaggctggggagctgttgtcctatcaattttgggtattgtcgcttcagtagtagttaagaaaaaacctaaagtcggaggagtattgcttcttatctcaggaattggcggagtaatttgtatatcaatgttctatttactgcctgctgttcttcttattattccaggtatcatgggacttgtcagaaaagataaaacgacaacaacagcagcttaaagaaaggcccttagcagggcctttcttttttggctaataaaaaacaaaatttctcgatatattaattttatacatatttttaaaattccaccattgtcaagtttatataagcaaattgcagatttacttgccgtaatgtaagagcataacaatactaaaagtttatccttcaaaatgaaagaggatgcttcgcaaaagtccattagactttcggaaacatcctcaatttctggatttcgtaaagaaatgttatttttttgttactttttcagctgattggggtgatgaaaaacggtcaaacccttggtatatcaagggttttcgccgtttaattacatcatgccgcccataccgcccatgccgcccatgtcaggcattcctgcgccgccggcgttttcttccggtttgtcagcgacaacggcttcagttgttaagagcattgctgctacagaagctgcgttttgcagggctgaacgtgtaacttttgtcgggtcaacgatacctttttcgatcatgtttacccattcgccagttgcagcgttgaagcctacaccgattttttcgtttttcagacgctcaacgatgacagatccttcaagacccgcattgtgagcgatttgacggatcggctcttcaagcgcgcgaagcacgatgttgatacctgtttgcgcatcgccttcagcttccactgcagcgactttgttgtatacgttgactagcgctgtaccaccgccggatacgatgccttcttcaacagcagcgcgagttgagttgagggcgtcttcgatgcgaagtttacgctctttcagctcagtttcagtcgcagcgccgactttgatgacagctacgccgccggcaagtttcgcaagacgctcttgtaatttttctctgtcgaattcagaagttgtttcttccacttgagcgcggatttggttgacgcgagcagcgattttttcagtgtcgccggcgccttctacgattgttgtgttttctttcgttaccacaactttagaagcgcgtcccaattgtccgatttcagtagatttcaggtcaaggcctaagtcttctgtgattacttctccgcctgtaagaacagagatgtcttcaagcattgctttacggcggtcaccgaagccaggagctttaacggcaacagcgttgaatgtgccgcgaagtttgttgacaacgagtgtagcaagagcttcaccttcaacatcttcagcgatcagaagcaatggtttgccttgctgtacaacttgctcaagcacaggaaggatttcttgaatgtttgtgatttttttgtctgtgattaagatgtaaggattgtcaagaaccgcttccatcttatcagagtcagtcaccatgtaaggagacgcatatccgcggtcgaattgcataccttccacaacttcaagctcagttgtgaagcctttagactcttcgattgtgatgacgccgtcgtttcctacgcgctccattgcttcagcgataaggcttccgacttcctcatcagcagcagagatcgcagcaacctgagcgatagactctttgccttcgatcggcttagaaatttcttttaagttttcgattgccacggttacggcttgttccatacctttacgtacgccgacagggttagctcccgcagttacgtttttcaggccttcgcggatcatagcctgcgcaagtacagtcgcagtcgtcgtaccgtcaccggcaacgtcgtttgttttgctggctacttcagctacaagcttcgcacccatgttttcaaacgcgtcttcaagttcaatttcttttgcgattgtcacaccgtcatttgtaattaacggagaaccgaattttttctccagaaccacgttgcgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgattacagctaaaatgtcgctttcacgtaagattaagtattcagtaccttcgtatttcacttcagtaccggcgtattttgagaagataatgcggtcgccctcttttacttctaaagcaacgcgctctccgctttccaacacgcgacctgaaccggctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacagttattataataaagaatctcacttccaatttcaagtcataagaataaaaaattttcacgcttacatgattctctctcacactgattttctccttttttcacgtcaagatcacttgtgttacaataagaacaaataagttgattttataggataaaggagtacatatcatttgagaaaacagtattggtatatcattttgacatatgttatcatgcagctttccgccttgatcggcattcctttaatgtacaaattcggctatgcgggcgggcaccctacgaatgcgaatctcaccatggctcaggggatttattccgtcgtaagcttttttatctgcctgattatcgttctcttgattttgagaaccgcgccgaaacagacattaagaaatgggaagaaagcatccgccggcatgtccgttctctgggcggtcgcgggaatatggctcgctttattttctcagggaatcgccgggatgattgagcagtatgtctttcatgtgggcagcggttccgaaaacacgaaagccattcttaacattattaaagccatgccgctcatgattatcgtttcttctatcgtcgggccgattcttgaagaaatcattttccggaagatcatcttcggtgtattatatgaaaaaacgaatttctttatcgccggactgatcagttccgtcattttcggcattgtgcatcaagacctcacgcacctattgctgtatacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgagcaaatgcaattaattattggaggattgtttgtatgaggaacccaatgacttggggcttgatttatttcgcagtcggctgtatctttacgtatttggccgcaagctctccgggaagcatgtggtctttttattccatactgctgatggttttcgccgcttataatatcagcatctcgtttaaaatgttcgccttctcatttaaagtgaagaaaaaccaaaaataataaaagaaaagccatttctcatcattgagaaatggctttttttatgctgatacgtcctggtcagattcactgccggtctgccttttccgatacgccgcttttgaaatcaggatactgatctcgtataaaatgcaaagcggaatggtaatcatcaagtgagacagcagctcaggcggcgcaatcatcgcggcgatcacgagcagcacaaaatatgcgtatttcctgatcttcgataaaaacatcggcgtgataacaccgagtctcgttaaaaacatgatcagcaccggcatctgaaacagcagcccgaacggaatcgtcagctgcagcagaaaatgaaagtactcggtaatcccgattacctggttgacatccaggtcattcgagacccgcttcataaaatcaacgaccagcggaaataaaatataataagaaaacgacacaccgccgacaaacagcacgatcgaaatcggaatatagctgagtgttactttgcgctccttctcatacagacccgggctgacaaacgcccaaatctgatagagaataatcggcgaagtcaaaatgatgccgatgataaacgcgaactgcaaaaagataaacagcggatccgtcaggttaaaagcattaagggtgagctcttttacttcatcggctttttgaagatacacaatgataggttttgccagaaaaaagccggcaataaagaaaaccgtaaaggataacgccacaatcagcaatcgtttccgaagttcggcaatatgctccacaagcgtcatttgattcactctcatacgcgtcatcctatcttactgttcttctttctttttttcctcttcttcaccggctaatcccttagtagcgttcttaaattcacgaagcgtgtcccccgccgcttttcctaattcgggaagcttcttcggaccgaaaataatcaccgccaccacaccgataaccgccaggcttccaggaccgatcatgtgcagctcctcctttcgctattcaatttcttccaaaacagaataatgctttaagaaataaaccaatgattgaagctctactgctaaatctatatgatgaattcgaatgtgatccggcacattcaaacgggccggcgtaaagttaaggattcccttgattccgagtgacacgagccggtcggtgattgactgggcggcaaccgccggaacggtaagaatcgccacgggttcatcctttatgtgaagctctaaatcattaagatcaaagacaggcacaccgcctacctcagttcctattttactctgattcacatcaaaagccatagatatttttgtgttattattttttgtgaaattatagtgaagaaacgccgtccctaaatttccgacaccgatcaaaatgacgttcgtcgtttcatcctgatccagtgtttttctgaaaaatgacagcaggtaatccacattatagccgtatccttttttgccgagcgccccgaaataggaaaaatcccggcggatcgtggccgaatcgacttttaccgcatcgctcagttcagccgatgaaacgcgctgctttcctgacgcgtgtaaattctttaaaaagcgataataaagcggcagccgttttgccgtcgcctgtggaatttttgattgatccttgttcatgattggtcctccactttatactcagatgcatctcttttaaaatcaccgttttttcctcctgttttttccatgaggcaggtcgggccgatgaccattcctttatccagcgccttgcacatgtcatacacggtcaaagcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcggccataattcctgccacctgtgcgacagccagcacgtctccttttccgatctcgcggttttttattctgctgtacacgtcatgtttcatgtgtacgctggatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatctcgggatcgcatcgccatagtaggcagaaacggagccggcaaatcaactctccttaaaattatcgcaggtcacctttcatatgaaaagggtgaattaatcaaaccgaaagaattaacgatgggatatcttgcccagcacactggcttggaatcccagcttaccataaaagaagaactgctgagcgtttttgatttcctgaaagcaatggaaaaagagatgcgctctattgaagaaaagatggccacggccgccccggcggagcttgagacgctgatgaaaacctatgacaggcttcagcaggatttcaaggataaaggcggctatcaatatgaagcggacgtccgatctatccttcacggactcggcttcggaaaatttgacgattccgtgaaagtgcaaagcctgagcggcggtcagaaaacaaggcttgcgctcggaaaactgctgctgacccagcctgatctgcttattctggatgaaccgacgaaccatctcgacatcgatacgcttacatggcttgagcattatttacagggatattcaggcgcaatcctgatcgtttcccacgacagatactttcttgataaagtcgtcagccaagtgtacgaggtctcccggacagaaagcaaaaaatacctcggcaactacagcgcctatttagaacaaaaagccgagcagtatgagaaagacctgaagctgtatgaaaaacagcaggacgaaatcgccaagcttcaagattttgtcgaccgcaatctggccagagcttctacaacgaaaagagcccaaagcagacgaaaacagcttgaacggatggacgtcatggccaagccgctcggggatgagaaatccgccgccttccgttttgacattacaaaacagagcggaaacgacgtcctgcgcgtacaggatgtttccatcagctatgacggccagccgccgctcttgaaaaacctgaccttcggcattacaagaggcgaaagcgccgccctcgtcggaccgaacggaatcggcaaatcaaccttgctgaaaacgattatgaacacgatcagtccggaatccgggtcgatcacgtacggttccaatgtcacaatcggctattacgaccaggagcaggctgaactgacatcgtccaaacgcgtgctggacgagctgtgggatgaatatccggacatgccggaaaaagagatcagaacatgcctcggcaactttctgttcagcggagacgatgtcctgaaaccggtccgttcgttaagcggcggggagaaagcaagagtcgcgcttgccaagctgatgcttcaaaaagcaaactttctcatccttgatgaaccgacaaaccaccttgacctggacagtaaagaggtgctggaaaacgccctgatcgactacccgggaacactgttatttgtatcgcatgaccgctactttattaacaggatcgccacaagagtgctggagctgtcacctgatcatgcagaagaatatttgggagactatgactattacaccgagaaaaaagcacagcagctggaactggaagaaatgaagcggcaggaaaaagagcaggctcagcctgccggcaaggtcaaacaggatacgaaaagaacttacgaggaagaaaaagaatggaagaagaaagaacggcagcgcctgagacgcattgaagaaatcgaagcggccgtctcatccgccgaagagaaaatcagtgccaatgaggagctgctgtgcgaccctgacgtgtatcaggatcatgaaaaggtacagaccattcacgcggagaatgaagccctgaatcaagagctcgaaaacttattagcagaatgggaggaactctcctcagaagaatagaaaaagtcaagcacctctttaaggggtgcttttttatccacagctatcctccttgtcagccatttaagtaagcgttttatacacactatccacaaaattttctgactttatccactttactaacaactttcagtcccttatccagactggatttctgaatatattcacaatcctgtggatatgttagaattatctgttaataagtaaaaaaagcctcacgttttacaacgtgagacgatcaaaggatgttaattccaaaccgggctgtccgttcatatcgtacgagccccggatccccttttcaaaagcaacggttccggcagccgcaatcatcgctgcattgtccgtgcataaagaaagcggcgggatgacaagctcgggatctcccgaatggctgaattcctgctgcagtgcggctctcagccctttgttagcggctacgccccctgcaagcagcacttgtttaaccccgtattctttcgcggccttagaggtttttgccgtcagtacatcaatgacactctgctgaaagcttgcggcaagatcctccggaggaatcacctcatttttttgcgaggcgttatgaagcgtgttaatcacggctgatttcaggccgctgaagctgaaattgtaagacccttcttccagccacgcacgcggaagcggaatggaatccgttcccgcagcagccagcttatcaatctgcggccctcccggatagggaagccccatcgttcttgccactttgtcgtaagcttcgcctgcggcatcatccagcgtttcaccaataacctcgaatgaaccgtgctctttcatataaaccaattccgtatgtccgcctgacacaaccaaagcaagcgccgggaactgaagctctcctatcagcctgtttgcataaatatgacccgcaatgtgatggacgccgactaacggtatttgatgggcaaaacttaacgcctttgccgcattgactccgattaacagggctccgacaagtccgggtccttccgttacagcaatcgcatcaagatcatcaaagcccatctccgcctttgaaagagcttcctcaatcacaagggtaatctgctccacatgatgtctggacgctatttcaggcacgaccccgccgaaacgtttatggctttcaatttgagaagcgacaacgtttgaaatgatgtcttttccgtttttcacgactgaggccgcagtttcatcacagctcgtttcgattcctaatacataaatatcttgtttttcactcatgtaatgtcacccacattaataacgcgtcttccccgttatctgtatagtattgttttctgattcctccggcctgaagaccgaatttcttatataaggattgggcgggatgatttgagaccctgacttcgagagagagccttcttgcctttttttctctgcacaattctattgcagagcgaaacagcgcttctcccaacgattggccccgatattccggcttaatggctatgttcgtaatctgcgcgtcatctataataatccagattccgcaataccccgccagacagccgtccttttcaatgacaaggtagtgggcatacggattttccaaaagctcatgataaaatgaatccttcgtccatggagaagtaaaggatgctgtttcaatttcataaatttgatcaatatcttccggccgcatgcttcgaatcgccgttttcgttttcatccctatcaccctatttttgagattccatccatttcgcttcagcctctgccagacgcaaataatccggaacaaggctgtggacatccgtttcttctttttccaagcctaaaaacgccagctctgacggccgcggattatgctgtgcagccgttcctatcactgcttgagatgtcatttcatgcagaatggtttcttcatgaatggctgtatcgtgccctaaaaataaaaccggagacgctttttctttcagcatgcagagccaatcagtcaaaaggacattctgatcaggaagaacggattgtaatcggccgtcctgatattcataaagtcccgtatatacctgtccgcgccgggcatcaaataacgggcagatcagtccttgaaagtgccgtccgttagccgccagcacctccaggctcgagacagcggaaaccggaagcttcagcgaccatgccaatgtttttgccagcgtcacaccgattctgacacctgtgtacgatcccggtcctttcgccaccgctattttcgtaaggtcctgcggtgtcaggccgcaatccttcagcaatgaattgacagcaggcatcgcccgcacggaatgattcttttttaaatatgtaatatactccgccatcaccgttttctctcgaacgagcgcggcacccagcgtgtaatttgacgtatcaattgccagtattgtcatgtttatttatctcctcacaaagcgtttcataccgtgttccgaaagccgtaaaggtaatgtcccttgcctcatcaccggctctcttgatgacgatctgcagccgttcagcaggcagctgatcctgaattaaatgagcccattcaattaaacagacgccttgtccctcaaaatattcttcaagccctaagtcttcgctttcatcctccatacgatacacatccatatgatatagaggaatcgaaccgtcatggtattcttttataattgtaaaagtcgggctgtttaccactctcgtgattcccagtccttcggcaaaaccctttgtaaaagtcgtttttcccgcgcctaagtcgccttccagtgtcaaaatgtctcccggctttgccaaagaagcggcaagcttggctacggctttcgtttcttcggggtttttcgttctccattgtaatgtcttcaaagtgagtcacccgtcttatttaaaatgattgtatccttttttctcaaggacgatttgtctctgatcattggctgtcaaaagaacacatgcttccttccgttcagataccgcccctatcttcgcaatcggaatgcccgattgagtgcagtaatcaagcagagaggtccactcttgctgagaaaccgttccaaccaattcaaaatcttcaccgccgaataacacccatttcttccactcagaatctgcctcaggcaaatccggatgcaccggcagaagttgttcttcaatttctatcgtaactgaacttgccgcagctatttcatgcagctcactggccaatccgtcactgatatcattcagagccgcgcgctgaagctgagagcagaagcggccgacttgaactctcggaacgggccgtttatgttttcggataaaataatcactcgtgtgaaatgcagaaggaagtgtttctcccaacaaaagagacagtcctgctgcggacgagccgatatcccccgtaacaaacacaacatctccgggtcttgccgagcttcgcagacaagcgcaatccttctcaacttcaccgatgacagtaacggtaattacggcttgaccggaagcggagacggtatctcccccgatcaaatccatttgatatagtttcgccagttccgccattccttcatacattacctggacgtcagctttctgccagcaagaaggaaccgctagagacaccaaataaaacttcggaatgcctcccatcgccgccacgtcactaatgttaacagcaagcgccttataaccgatatcatgaggagaggaatactctaatttaaaatggacattctccaccattgtatcaaggcagacaatttgctgcatatggggtgacgctgtataaaccgcaccatcatcaccaatccctacatcgacggaaggatgataatgcgaatgcggcgtaatactgtgaatcaactcaaactcatccatatatctcccgtctccctttctgacgctcttgtgaaatacagctctttctagtgtatcggattatgtttcaatatccaagactttaacgatataaaagaaagcttggttagataccaagctgccagcattaaaagaaaacacaaaaaaaacgaaaacatgatcgtttcgtttacaataaaaatggcggtccggacgggactcgaacccgcgacctcctgcgtgacaggcaggcattctaaccaactgaactaccggaccatttaatttttggttgcgggggcaggatttgaacctgcgaccttcgggttatgagcccgacgagctaccgaactgctccaccccgcgatgataaaattttagaaaaaccggagtaacaggcccaaccggtccaacgggtgtgactggagcaactggagtaacaggagtatcgggagccaccggagtaacaggtccaacaggctcaaccggatcgaccggagtaacaggcccaaccggagtaacaggtgtgactggagcaacgggtgtgactggagcaactggagtaacaggagtaacgggtgcaaccggagtaacaggagtaacaggagcaacaggagtaacgggagcaaccggagtaactggttcaaccggagtaactggttcaaccggagtaacaggatcaaccggagtaacgggagcaaccggagtaaccggggtgactggagcaactggagcaactggagcaactggagtaacgggagtaacgggagcaaccggagtaacaggagcaacgggagcaacgggagcaaccggagtaacaggagcaactggagcaacgggagtaacaggagcaaccggagtaacgggagccaccggggtaaccggagcgactggagtaactggggtaaccggagtaacaggagccaccggggatactggagccactgggataactggagccactgggttcaccggagcgactggagtaactggggtaaccggagtgaccggagtaacaggcgcaaccggagtaaccggggatactggcgctacaggagccactgggatcaccggagcgactggagtaacaggagtaacaggagtaacaggagtaacgggagtaacgggagtaacaggagtaacaggagctacaggaataacgggagctaccggggtaacaggcgctaccggagtaacaggagcgacaggaataacaggtgcaactgggatcaccggagcgactggtgcaactgggatcaccggagcgactggagtaactgggatcaccggagcgactggagtaactgggatcaccggagcgactggagtaactgggatcaccggagcgactggagtaactggggtaaccggatcgaccggagtaacgggagcaaccggagccaccggggctactggagcaacaggcgccaccgggatcaccggagcaggcgcgatcattccgtatgcttctggtcttcccactgccgtgacgaccattgccggcggattaatcggaacggtgagccttgtcgggttcggcaattctgtgacgggcgtcaatgtcggagggggaggcgcaattgatcttaccggggctggaggaactctgctgaactttgctttttctgctccgagaagcggaaccattacatcaattgccgcttatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacagggctgaacattgcggtaactcctcaaacccggctgttaatggtattctctgccactgcgacaggcctttcgcttattaatacagtggcgggatatgcaagcgcgggggttacgatttcttaagtgagaacggccagactggtgcggatcatctaagctaagcttggagaagatatcattttttcttcaagcttttttgttttttacgtctttctgtaaaggctgacgggaatttcccgacagccggcagaagtatttacatgccttttgaagttaatcagtatcttaatgaagacgttttcagtgagttcgaatcatccgttgtgccgggagtgtgaatcatcatcgaaacagcggtgccctcatccggggtgctggtgatcgtcaattcgcttccgcaaaaatgcttcagccgccgattgatatttttcaggccgacactgcgattaacatcagaagacaaaatatctttctgtatgtccggcatgatgccggttccattatcctccactttgataagatacgtgttttcgccttgttttttcgctgtcagctttatccgtccgccgcctcttttcttactgatcccgtgatgaacggcgttttccaccaatggctgtatcattaaaggcggaagggggaagtcaatgtcctgttcaatatcaaaaaggatatcaagccgtttgccgaagcgtgttttttctatagaaagatatgacgtaatgatagaaagttcgtttctgaatgagctgatgtccgaagtgttttgaaaatcaaaactcatccttaaatagtttgtaaatgtagcagtggtttcccttgctttttcaatatccaaatggctgagcgcgataatcgtatttaatacattgtaaagaaaatgaggcttaatctgcgactgaagaaatgccatttctaaatttgtggcttggtgagccgtatgcttcattaaaattaaatttttaatacgcgcggtgaattcagagtaatgataaggcttttgtaaaatgtcgtttgctccggcatgaaacgccttgtatttgtcatggctgataatggctgccgtaacgataagaaccggcagatcgaccatgctgaacctttcgcggatgtttgtgcagacttcaaaacccgtcatgtcaggcatcatcaagtctaatatgaccaagtcaagcttcgaggaagagacagcttgaagcgcctcttttccgctttttactgcgattacgttataaggaacaccttccagcatatcaattaaaattttcaaactctcgatattatcgtcgacgatcagaatcgtcggagcatcgattttctctgagtgataaggcgtgaccagcgaaatatccggtattctctgtccgggctgtgatttaggaagttcggtctttgcttccggtaaagaaacaatttgagcggcgggtaacgtaaaatgaaaggctgatccttgcgccgccgctgactccgcccagatgtccccgttttggagcttgacgagctgtttcacaatacttaaacctaaacccgttccatcttcttccttccctcccgcttgctgaaaagaatcaaaaatggtttcaagatcagcctcaggaatgccgctgccggaatcggtcacggttatttgaatcattttgtcattcaggtttgcggcggaaagaataatgttcccctcggatgtgtacttgattgcattttcaataagattggttaagatttgccggaatcggttttcatctgcaagcaccaaagggagatcgtccggcacatgattaagaatcgcgagttttttatgtttggataaaagccggtagaagttcatctcactgcatatgacggcatgcacatcgacgggaaccggacgaatctgcagcatcccctgcttcattttttccaaatcaagaatatcatttacgagatcggaaagtctgtagcccatacggatgatcagctgcatattttctttctcttcctctatcgtcttcttttttctgccggctacaagggtttggcatatattaataatgctgttcagcggcgtcttgaattcgtgtgaagttttggcgataaattcatctttcagttggtccattttgactaatttccgtgagaggacttcattgtcccggaaagctccggcgaattgctgcgccatcaggagaaccaccgccaataaagcgatgactgtcggcaatgaatagatcgaattaaaagaaaaagctgttttgccgctgtaagctgaaatggtcgtaagaatcacaaaagcgctcatcgagacggatgcgagtgtaaggtacgtgcttccttttatttttcttatggcggcaatcgtaaaaatatatgtaatataaaacagagtcgtaacggccagcacagaatgtaaaatgtatgagaggtggtcaatgaaacttccggacataaaattagtgatcaagatgatcccggataaagcggttaaaatggtgatcgtcgtttttgaaacaatttctctgtatgcataaaagagataaagaaaaaccgccatgctgacaagcacggttgagatgatacgcaaggaattcagcaatgaaaatgatatagacggaaagaggagaaagataattctttctttcccgatcataagaataatggctgaaaaaagcagacacatcacggaaaagaacaataaatgtttatcctttgtccgttgcagaaaaaagccgagaaaatataaaccggtaatgaaaaaagccgtaatcataatggaatcattaaaaaaggaaatttgattctcgcgtataatttgttcttgagtcccaaacgttatcggttttgcgatcccccagccgggaacttttccgaaattcgaaaaatgcaggacaagttcattgtcacccttgcgaagcctgaaaaagctgctgtacggtttgttctgcgccttaaaatcagctttttctgaaggattgccgctctgtccgattacttttccattaagataaaggcggtttgaactgtagatataagatgtgctgatccccaaaacctgattgtcttcatttgatcggattgtcagtttgtacgttccgtaatccacgtcggccgtttttccgaacagcttcacattgacagggacatcaacgagtacgggattttttccttttgctgaatgaagcgcctgcggtgacagcatctgatttggatatagaatccatttcccgttcagctggacatttccatccttttgaaaatcccaattttccagattgatcacgccctgttccgcttgagggagggatgatcctgaaaaatgatccatggccataaaaatcataaagaaagcagcatagccgcaaataatcgtaatcgaaataaatttttctttcacatcattactcctttatcccattcaggggcattctattatcctatttaatgtataaatattgtaatcacaaacgttataatacaacaagagaaagaaaaagaatccaactatatagggcattgggcatggtataattgaaattattttcagatatatctatattgacgggtgggatgcggtttgaaagcgttaattgtggatgatgaggaactggcattgcttcattttaatcgtatgcttgagcggacaaacgcctttcaatctattataacgtttcaagatccggcggaagttctggagcattcggaactttcagcagctgatgcggtgtttcttgacattgaaatgcccgggataaacggtattgagcttgctgaatcgattcaggaggtcaatgaaaatatccaagttatttttatcaccgcttataatgaattcgcgatcaaagcgtttgaattaaatgctgtcgattatctattaaaaccggttgacaatgcccggctgctgacaactgttgagcggatccgaatgaataaaaaactcaggtcggcggacgggaataccgggacggattatgttatacaatgttttgggaacctggacttttatcaatcggtaaatggtgtcaaaacatacataacagtcaagtggagaacatccaaagcccgtgaactgtatgcatttttacttcttaatcaagggcgcacggtcagtaaagacatgctgatggagatgttttggcctgcttatgatatatcaaaagcaagcacccagctctactcgacaatatatcagatacggaaattaatcggtcagctgcccttcagccaatcaatagaaaatactgatataggatacattctccggctttccggggtaaagattgatacagttgaatgggaaaaaacattcaaagaggctcctccgctcagcgcagctgcactaacccggcacatgaacatggtcatgtcatatgagaaccattatctcatggagaatggctatctgtgggcagagccggaaaaagtgcgtcttgcccatctgtggctcagcaaagcgtacgaactgattggttttctcatccaagagaagaacgatcgtcaagcgatggacgtttgcctgcaggttgagaaaatagagcccggtgacgataaaattatacaatacaaactgcagttatttaataaactgggaaaggtagaagaggcgataaaggaatacgaacgatataaacaattaaaagataaaatcaattgacgattgaatgaccggaccggctgatgccggtctttttttgtgcgctatttctgaaatgatcccatgtacagaatttgtataggccgatttcatacaatgtagtttggttcggataaggagaatcccatgcttaccggcttgttcgaacgtaagtctatataaaaggggaggaataagacattgggagtgaggaacttttcgttcagcccgaaaaaaagcaaaaggctgagggcggcattgatttcatgcttcacgctgtttttcatcttcagccaagttgtcagctttactccgatcgcagccgcttccggatcacaacatagcgagagcgggttctttgattcagttgcagtcaaagacggcagacagcagaccgttgacggatcaaaagccggtgaaccggctttaacaccgggagataaagtgacactgacatacgaatggtcactaaaacacaaagaagatgcaagtgaccggaatatcaccgtaaagattccggaaagttttacattagataatgatgccgaaggtgagctgaaatcagctgatcgggtgatcggtatatataaagctgaagcaaacagaagcacgctggaagtgaaagtgaacgatgctgaagcggatgccggggatgccaaaggctccattacactgtcggcgaagtttactcccgacataacagatgagacgaaaatggcaaaagctctttttcaactggatgccggcaagacccagcaagtgttaatacctgtgaagaaagacggaacaacggattccgatacagaaaaaaacacctcttcaacacctgctgaacctcaggataagacagagaaaaaatcagcatctgcagacggcggggataaagcagaacaggcaacgaaatcaaaaccttctgctaaacgcagtcaatcaaaaatggtgattacaagcaaatctgccgctaaaagccttcaatcaggcggaaaccggattacgcaaaatattttaactgatgtgaaattgacggatgaaaaaggaaaaccatatgacaaaaacaaccctgcgaatacgaactctccggcgaatatcaccatccaatgggcgattccgaatgagctggggaaaacaataaacgacggtgatcgatatgaatttgacctgcctaaagaatttattatgcataatgacattacgaaccagccattgaccgacggcgatagtacgtacggaactttttccattaatacgagcggccatgtcatcatgacgtttaacggcgaggtaaaagaagattctaacgtcaaggggtcattgtatgtaaacacccaattcaatcagaaagaaataaaaggatcaaccacacaaaagattaagtttccggttaactctgatacgccggacgtaacggtttattttaaaccgaatgtcaataaaaccattgagaaatcagggtcattggataaaggcattaatcccggaaaggtaacgtggacggttgaccttaataaaaaggaagaagaagttaaaaatgcgaaattgactgaaagccttccggacgaattgactttccgctctgtgaaagtgtatgaacttgatgtgaatattgacggctcggtgagtcagggaaatgagataacttcaggttataccgttggcgaaaacggtaatgtcaccttcgccgggacaattgattcagcctaccggctcatatatgacacggaaattaaagatgaggcaaagccgggtaaaggcggaaacatcacgctgacaaacaaggcggcattcagcggagacaatgcggagccgatttctgcggaagcttccgtaacagcgggttacggaaaaatgatagaaaaatcttcgacaggttataaaggagaaacccaaacgttcagctgggctgttatgtacaactacggtgagaaaaagattgatcaatccaaagccggcattaaggatacgttcggatcagacgatctgcatctagttcccggatcattgaaagtccttccgattacattcagccagaacggcagcgaacaagagggcgccccattaaaagagggtgatgattatacgctgactgataacgggaacggctttgaaataaaattcaagcaaactgtcacaggagcatataagatcatttatcaatctcaagtcaacgatggggtcattattgacagtcctgtcaaatacaccaatacagcaatgacagatacgggggactcaaaggaaactccgggaaccgccattcagcagaatctgatcaaacattattcaaacgcagactatgagaagaagacggttgattggacaatcacagttaacaaaaacggttacacaatgaaagactggacgctggatgatcaattcaccagcggaggcctggcgctcattgacgattcatttaacatgcaagacacgactgaaaacaaaacgctgaaagaaggaacggattatacattaacaaaaaaacccggaaatcaaggctttacaatagcattgatcggggactacgcagaaacaaacagtcagtttaagatcacgtataagacaaaattcaacgctgacttttcaaacgaaacgattaaaaatacggcggagtcgacatggaccgataaaaacggcaacaaacgcacaaataaggaatcgagcggcttcacaccgaacaatcagacgtcccataacggattcaaaaacggctcatacaacgccgtttcaaaagaaatcacatggaaagtcggcatcaattacaatggcgaaccttcaaaacatccttatataaaagatacgatcacagatggtcagcaatttttgcatgggtcggttgctgttaaaacgtataccatcagcaaaaacggctccatcactgaaggagaggcgctggatccttcaaaatatgaaatagaagagccgtcagacggcaacaaaaatacgttaaccgtacatctcaaaacagatgacgctgtaccatacctgattgaatttaaaacgtcattaaaaggccaggtcattaaacagaatcaatacacaaacaaagcagagtactttaataatgaccatgcagaccgaacgctgacgggttcagtttccgtcgcaaacggaggaaacctgatttctaaaggcggcaaacagaacggaaacaatatcgattggaacatcaatgtcaatgccagccaatcgacactggatgacgtaaaagtcaaagacacaccggatgagaatcaaataatagatgaagattcttttaaagtatatcaagcaaaatataatgagaacggcgttatgaaagacagcagcggaaatcttattccgggtgatgtgcagcttgagaaagataaggactataaattagatatgaaaactgacaatgccaccggtgaacaatcatttgcccttacctttacaggcggctataaacaaatcgaccgtgcgtatgtcatacaatatcgttctctcattaatatttccggcagcagcggtcaggtcaacaacaaagtgtcgatatcagggacgaatgttgaggagcagacccaagagaacaacagctcagtgtttgtcgctatttcaagcggcggcggctcagggtcaggggagaagggaagcctgacgatatctaaaacaggatcagacggaacatctctttcaggagcagactttcaattatggtctaaagacggcaagcagctgctgcgtacgggcacaacagacgatgccggtaaacttacgtttgggaatatccgttacggaacctatgtactgaaagaaataaaagcgccggacggctacaccatcagcgatgcttatgtaaacggggtctccgttacgattgacggcaaatcctccgcagcaggagcactctataaagtcataaatcaaaaaaataaggtgacgcttatcaaaaaagacgaaaacaataatcctttggccggtgctgtatttaagcttgagaaaaaatcaagcgacggtacctatactctgataaaaaataatattgaaagcgataaaaatgggaaagttgagatcaacggtttgcccgccggatactaccggctgatggagacgaaagccccatcagggtttatcgtaaacacaaaagccattcacttctcaatcgcaaagaacgaaaagaatcaagtacctgatgttgaattgggatcaatggtgaattataaaggaaaagccgctttaacgaagaaagatgcagacggcgggaaccttgaaggcgcagttttcaaaatcgtcgatagtgatggaaaaatagttcaggacgatctggtttcagataaggacggaaaagtagaaacatccggccttgccccgggtcattacgccttcatcgaaacgaaagcgcctgacggctatgtgttaaatacggagaaagtggagtttaccatctcagaaacagcggaaggaaagccggagtcaactgacgcaggaacggccgtcaactataaaggctctgtgttgctgacgaaggaagatgcggaaggccgaaaccttgaaggtgcagttttcaaaatcgtcgatagtgatggaaaaacggttaaagacgatctggtttcagataaggacggaaaagtagaaacatccggccttgccccgggtcattacgccttcatcgaaacgaaagcgcctgacggctatgtgttaaatacgaagaaagtggagtttaccatctcagaaacagcggaaggaaagccggagtcaactgacgcaggaacggccgtcaactataaaggctctgtccggctgacgaaggaagatgcggaaggccgaaaccttgaaggtgcagtcttcaaaatcgtcgaccgtgatggaaaaacggttcaggacgatctggtttcagataaagacggaaaagtagaaacatccggccttgcacccggtcattacgcattcattgaaacgaaagcgcctgacggttatgtgttaaatacggagaaaaaagagtttaccatctcagaaacagcggaaggaaagccgaagccgtctgagaccggcacctttgtcaactataaaggctctgtccagctggttaagaaggatcaagacggaaacgttttagacggtgcagtatttaaaatcattgacagtgatggaaaaaccgtaagagaagatctgatgacaaaagaaggcggcaaaattgacgccggcggtttggcgcccggaaactatcaatttgttgaaacaaaagcgccggatggttatctgctgtcaacaacccctgtgcggtttacgattaaggctgagaacagcggaaaaccggatcaggctgccctgactgcagttaacatcaagaacagtgttgttcttacaaaattggatcaaggtgacaaacggaaagtcctgcaaggtgcgaagtttaatctgacagatgcaaacggcaaagtgctgagagaaggtctgacgacagatgagcacggacagattgttgtacggggactgaaagcaggcgaatatcaatttatcgaaacaaaagcgcctgaactttacagtttggatcaaacgccaatatcattcaagatcacaaataccgacataaaaccagtcgaaatcagtgcggagaatacactgacgccgggtgatgtaacactgacaaaagtggatcatgacgataaaaataaggtgctggaaggtgctgaattcaagataacggattctgccggacatccggtaaacaccggcggcagcaaagaacggccggcggtatggaagacggatcaaaagggccggtttacggtgaaaggattagcgcccgggcagtatcgatttatcgaaacaaaagcgcctgacggctatcagctgaacgaaaaaccaattgaattcacaattgaaaaaggacaatcaaaagctgttgagctcgtcgtttctaataagaaattaaaaaatcccgcacctgggaaagacacaccgaatcatcaaacgaatcaaggcgggcatcaccctgataccaatagtaaaaccaatcacccggatacaggcaaaaatctgccgaaaaccggtgatacggacggtatgatgccggtcacggccggtattctgctgctattagccggcggagccgcggctgttgaatcaagaaagaagaaagcaaggaatagatagacgtaatcgcacctgatcatgtaagaatcgatcaggtgcttttttaaaaagagaatcatttctcaccaaatactcaccgcatgacgtacaagaaaggaattttcttcatggttaaaaaaatgatcattgccgttcttattttgtccgggctgcttctcatttcctctcctctcatgaaaggctgtttgattgcgtacctcagtaaaagccaaattgaatcggaattgaccgcagaacaagcgcggaaaaataacatgaaaaaagcggactatgaatttgaatccattcatccgcccggtttcagggaaacagttcagtcaagttttaatcgcaaaccgaaaccgataatcggacggataaccatcagcagcatcgatttagaccttccgattttaaaaggcacaaccaatgaaaacctgctgatcggcgcggcaactatgcgtccggatcagaaaatgggcgagggaaactacccgttggcaggccaccatctgaagcaggagaacctattgttcggccctcttttacacataaaaaaaggtgcgcaaatcgtgattaccgactttagaaaagactatatttattctgtaacatcaaaaaccatgatttcagaaatagaagcaaacgcaattcaggagacaaaagataaagagattacattaatcacatgcgacaaggcggtaagaaccgaaggacgcctggccgtcaaaggaaaattgattgatatttccggtcattcaaatgtatctcagccatcatagagaaacactttgtcaactgaatatacgtccgttgtgaaacatcccgagactggctcatgtcagtctttttttgcgcagggattataaaaagttcatccttcttatctctcttgagggaaattataccagactgcactttttgaaagaaatgacaagagaaaaagatcacgaaaattctcaaaaatgagaaataaagatttaaaaaatggtatgattttaggaggaaaggacggctggtgctgtgttggaagcgaagcggttttatgtctctctgcaaatgaaaatcgccggattaattacggctttattaatacttgtcatcggaacgctcacggttatatttgcctttcagcaattaaaggaagggcagaagcaggctgaacagctggcggtgcaaacggcaaaaaccatttcatatatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaataaaaccgtcatgttcggcgggtctccggtttccgacggaatgaaggccgtccggggaagcgccccggttattttggaggaaaaaaatcataacgaagtcgtcggaacggtgacagtcgaatttctacaagatgagatagaaaaagatatgaaggcgcatttgcggcatttaggctattttgcatgtttggtgttccttatcggcatcgggggagcggcggcgctcgcaaaaagcatccgtaaagatacactcggccttgaaccgcatgaaattgcagcgctgtacagggaacgcaatgcgatgctccttgcgatgaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaattaccgccgaacgtggaggtgcgtgccggagataaagtatttatcttaaacgtgaaagaaatgaagcagaacggacaagtatacggagcggtgatcagcttccgcgaaaaaacggagctcaagaaactgattaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcacgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccatagccgaaaaagagaaaaaagaggtatccttttttatgaccgatatcggcagggatatcgtcatcgaagtggcggattcaggagacggcgtgcctcaggaaaaaacagaaacgatatttgaaaagggctactcttcaaaggggacaaggagaggatacggcttagccaatctgaaagaagccgtcagtgagttgcagggatcgatagagatttcgcagcaaaagagcggcggtgccgtatttacggtgtttataccgaaagaaaggccaaagggggaatcggtgtgattaacatcgcgattgcagaggacgactttcgaatagcgcagattcacgaaaaatttatcgaacatcttgatggattcaatgtcatcggcaaagcaatcaatgccaaagacaccatatcgctgcttgagaaacggcagcctgatctgctgcttttggatatttatatgccggatgagctgggaacagatctgctcccgcttatccgcggccgttttccttccgttgatatcatcattattacggcttctgccgaaacaaggctgctgcaggaagcgctcagatcaggcgttgcccattatgtcataaaaccggtgtcggcacataaatttacagaagtgcttttgcagtaccgtgaaaaaagagaatggctgcactcacagccggagctgagccagtccgtgatcgacatgtttttcggaagcggtcagaaagaacaaaaacagcacaatgatctgccgaccgggattaattcgattacgcttcaaaaaatcaaaaacgagctcagaacggctcaaaaagggatgacggctgaagaactgggagaaaaaatgggtgcctccagaacaacggcgcggcgctacgccgagtttctcgtttctcgggaagaagcgctcgctgaattagagtacggcattatcggcaggccggaacggaaatattatttagcacatgagtaagggaggggagaaatgaagcggttgggagtgcttcttgtcatgctggcggcgctggtttcttttgacggacggcaggcggcgggcatccgttcagctgaagggccggttgaaattgtcgtcccggcagcgcctcaagggggctgggacgtaacggcaaaagctttgcaatcggtaatagagcggaagcaaatattaggccggcccgtaaagatcatctataaacccggaggaggcggagacagcggctggaaatatgtaaacgaacgaaaaacggatgtcatcagtatgaattcaagtctgctgttaagcaatgaaattttgggacaaagccggctgaaggcagctgattttacgcctttggccattatcgcaaaagagtggcagaccgtcgctcttccgaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagcaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatccgcggagtggaagcaaatgttgaaaaaacgggattgggagagcttttataaaaacagcagcggcgcaaaacgctttttagaagagcagaccgagttttataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcatgatgagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggtattgaacaggtggcgccgatcgcagtgatgattatgtttgcgattctttatttcggcattatgattgataccggtttatttgatccgatggtgtcgcgtattttaaagctggttaaaggcgacccgctcaaaattgtagtcggaacagccgttttgaccatgcttgtcgcactggacggagacggctcgacgacgtatatgattacgacaagcgcaatgctgcctttgtatatcatgctcggaatccgtccgattattttagcgggaatcgccggggtcggcatgggtatcatgaacacgattccatggggcggcgcggcgccgcgtgcggcgagtgcgctcggcgttgatccggcagagctgacggggccgatgctgcctgtcatcgcgagcggaatggtgtgtatgattgtggtcgcttatgtactcggaaggatggaaaggaaacggctcggggtgatcgaattaaagcagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaatgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagactgccgtggcgtacggtgtagataaggtggaaatcgcccgcgcttcgattatcggccagccgattcatatgttaagcccgctcgtgccgtcgacgcatttattagtcgggcttgccggggtcaccattgatgaacaccagaaatttgcgatgaaatgggcggttcttgccgttatcgtcatgacggcctttgcgctcatcatcggcgcaatcacgattttttaacataaaacacccggttcgtcgcacactaaaggcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcgtcggagatgattacaaatgaaatgaaacgccggttcaaagaggggtatgagctgaaggcggtcattttgacacacggtcattttgatcatgtcggtgcgattgaagaactgcttgagctttggaatgtgccggtttacattcatgaaaaggagcttccgtacgtcacggggaaagcggattatccgcctgccaggcccgatgcgaaaaaagggcttgtcgcaaagctgtcaccgctgtttccgcgccatacgatccgcattccgtccgttcaggcactgccttcagacggtaccgttccgtttcttgaagaatggaaatgggtgcatacgcccggtcacacacccggccatatttcattattccgggataaagaccgcgtgctgcttgccggtgatgccgtgatcactgttgaacaggaatcgcttgcggacgttgtcattcaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagatcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcgggaagcggaccgaatttgatattctgccgctgcttttccggatgaaaggggacgggcagccggtctggtatgacctgcctcagacgctcgtgaaagaagtgccgatcacccatccggatattgaagagtttgccgatttaaatctcaggtggtacggggttccgattatcgccgatatgaggcttgaaatcggcggactgtcgtacaacgcggcgccttttaacggatggtatatgggaactgaaatcggcgcaaggaaccttgctgacgaaaagcggtatgatatgctcaaaaaagccgcttcggtcatggggatttccgccagcctgaataccgacctgtggaaagatcaggtgctggtggaactgaataaggcagtgctctattcatacaaaaaacacggtgtcagcattgtcgatcaccatacggccgcgaatcaatttaaacgctttgaagaacaggaacaagacgcgggcagaaagctgacgggcgactggacctggctgattccgccgatctcgccggcttccacccacattttccataaatcatatgacaatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctatcttatgtctgtcggcttccatctggacgaagtagcgaaaacctacgccctgaacccggccgtctgcaatcatatgatactgaagcatggaaaaaccacctttttcttactatgataaaggaaaggtaggatatttcgcaaaggatgtgaacgagatgacgcaagactattctgtcttatctatcaatctcggaaagcccgcaattcatgaatttgccggcagacaaatcaattcaggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggcgacatctttcagctgggtgaagccgtcgttcaagtaagccagccgcgccagccctgcgtcaaactcgcgctcaaatatggcatcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcagacaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccagcagattggcaaggaagtactttttgaagctttgaagctttcttccttcatagtgggtaattccttttttctttaactcttctacataccagcctttactgccataatgcatgtcagaaaactcctttctccgttctcccgctggggaggtttcttcagtttttgccaaacttttggcattgtaacatctataaaaagacgctgaaaagggataatgcaaaaactgagcctttcgattcagagatgtaaagctttcttacatatatatgtaaagggcggtcttttcatgcttaatggccggttaattttaacagcaccgttccgagtgtcatgattccgaaaacgacgccgaaataaatcagcatccccttctttttcttcaccccgtaaacggtgagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattatcatccgcgatgtcccacagttcttgtaagagtttttcttccgcattgcggggctcctcgtgtttggcgagatagtccccgaggatggcggcgcttttgatgattttgctgtcatccagacccagtttttttccggcggaaattttctgatgaaggtacgccttaaattcctcgaaatcctctaaaatctgctgtttcgttacgccgtgcatggcgtgtatttcgttttcaattttgattttttctttatcttttttcatgcgtctccctccttcgggttagttgttgtatacctgttcgggagggagatgaaacattacaatgcagttaaaataatcggtttgtcttttgtaatcacgatggtgtgttccacttgggcgacaaggcttttatccggcgttttatatgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcttcatggtagacggctctgccgatctggttttgacgtttgccggcttttgcctgatccaatcctttctgaaatgcggatgccgcgcagttacaaagcttttgcagacgttcatcgccttctccgagcacaaatgaaatgcccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcggaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggaccgcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagctgcccgaatatctcgggtttttcagcgggcgcaggctcgttccgattgtaacggcgctgattaccattattttggcgggtatcttcggatttgtgtggccgccgattcagtcggtgattacgtccttcggggaatggatgatcgggcttggcgggatcggcgccgggatttacgggatttttaaccggcttttgattccattcggtcttcatcatgtgctgaataatattttttggttccagtttggcgattttcacggaaaaacgggagatctggcccgtttctttgcgaaggatccgacggcgggaacttatatgacgggattcttcccgattatgatgttcgggcttccggccgcatgtctggcaatgattgctgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaatgttctcggaatcaggtcaggtttttcattctcggcgggggcgatcgattatctcctcagctacggcattgccgaaaaaccgcttttgctgctcgttgtcgggctttgttatgcggtgatctattttgtcgtcttttatatgctcatcaaaacgttaaacttgaaaacgccgggacgggaagatgatgaggaagaagtgcttagtgaagatacggccggttccgtcgaagaacatgccatgctcaaggggctcggcggcaggcaaaatctcgaaacgattgatcactgtgcgacccgcctcaggctgaccgtgcaggatacgtctctcattaatgaggcggcgcttaaaaaagcgggagcaaaaggggttatcaaaactgggaataaaacggcgcaggtcattatcgggccgaacgtcgaatttgtcgcggaagagctgagagaggccgtccgccttgacgatcagaagcagacttgaaaaatccggatcacctatgtgatccggattttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtcctctgccgtttccctcgggggaaaacgtctggaaggcgaagacaaacgacgggtgattgatgattttaacgaagccgtgtttatcgaacggcattatatatacccaggggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtcgtcgcttattcagttctttccgacagcctgcaaaagcgcactatggccgccgccgggagctgaacataaaaaagccagatcatatcaatgatctggcttttgtttattctttttgatcgtctgctgaggattcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcagtgatctcatctttgtcgagcactttcgccatcgctttattatggttttcggagatgccgtagtggtctccgtacatcacgataatcgacttatcgtacaggccgtcttttttcaggtcattaaagaactgttcaattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcaggctctttaagagcggcatggattctttgaaatacggtttgtctttcatgccgtagtttttcgtattttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttgtcccgtttggtggaaaaagttatcaaagtagaatgtttgattatcgtgcgccagtttgtttaaaaacggcgtcacttccttgccgttaattttgtaatcaatgataaaggactgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgcccaagtatttcaccagatagtttcggtcaaatgagcgtgtcaaaagctcgggacggtcggattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaataaaaaatgaatcacaataatggctgtctgctgtaatttcttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcagcggcggttgatctgttgaatgacagctttaaaaaacacaaatggcacaaactgggatgtgaatttccgtatgatcacacccgattctattgaagaaagaggtgaacagtgatggatattgcgcatatcgtggctgaagataaaatcaagcgcgccattaaggatggagagttcgccggcatcaatggaatgggaaagcccctgccgaaagacgatgccgcacatcttccggagtcgctcagaatgggctaccgcatattaaaaaacgccggaatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtatacagacggctgggccgcccgtaagccggctctttatatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgtttgtaatctcaagccactttctcattttttcgatatccacttcggcagaacctccctatatttgatttgcgatcggcattgacgggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaattccgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcataaacatgtatatacaagttttttgagacaaaatgaaaacggttacggaggggttggcatgggtgagtttaaccgggctgcgcggcagatcgctgaagctgtcggcggaatcgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatcggggaagcgtccaaggatgacgtgaagaaggcggcatcgcaaaaaatgaatcctttacagcgtgctgtgaaaacgcttgcggacatctttattccgatcttgccggcgatcgtcacggccgggcttttaatgggtctgaacaatatcttaacggcggaaggcattttttacagcacgaaatcgattgttcaagtgtatccgcaatgggcggatcttgccaatatgattaatctgatcgcggggacggccttcgcttttctgccggctttaatcggctggtcggcagtgaagcggttcggaggaagcccgcttttgggcatcgtgctcgggctgatgctggtgcatcctgatctgttaaacgcatggggctacggtgctgccgagcagagcggcgatattccggtgtggaacttgttcggccttgaggtgcagaaagtcgggtatcaaggtcaggtgctcccgattctgctggcgtcttatttacttgccaggcttgagctctttttgacgaaacggacgccggagggcattcagctgttagtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtcatcacggggatgcatcatacgtttctcgcggtcgatcttcaattaatcggatcaaagctcggcggcacatttttatggccgatgctcgcattatcaaatatcgctcaaggatcggcggctctggccatgatgctcattacaaaagataaaaaacagcgggggctttcactgacggccggcatttccgcatatttgggcattaccgagccggcgattttcggcgtgaatctgcgttacaaatttccgtttgtgatcgccatgatcagctcggggattgcggggatgttcatctccgtcaaaggcgttctcgcaagctcggtcggtgtcggcggcgtcccggggatcttctccattatgagccggtactggggcccgtttgcgatcggaatgctgattgtgctgattctcccgtttgcgggaacatacgggtatgcgcggctgaaacggcaaaaatagaaaacctgcggggcgccttctatcaggctgtcccttttccctttccattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttctcgatgaagcgcacaaaagaggaataaaggtcgtcatggatcttgtcgtaaaccatacatcagtcgagcatcagtggttcaaagaagcggtttcgtcacccgacagtccgtatcgggatttttacatttggaaagacggaaaggaagacggccgggcgccgaacaactgggaatcaaaattcggcggttccgcttgggagctcgacccggcctcaggccagcactatctgcatttattcgatgtgtcgcaggccgatttgaactgggaaaatgaagagatgagaaaacaggtttacgacatgatgcatttttggttccgaaaagggatcgacggcttccggctggatgtgatcaacctcatttctaaagaccaatcgtttcctgatgccgaggatggtcgtgacgggcgcccttattatacggacgggccgcgcgtgcacgaatttcttcatgagatgaaccgggaagtgttttcgaaatatgacagcatgacggtcggtgaaatgtcctcgacaacggctgaccactgcatccggtacacaaaccctgaaaataaagaactcgatatgacctttaactttcatcatttaaaagtggattatccgaatggtgaaaaatgggcgctcgctccgtttgattttctgaagctgaaacggattttagcgttttggcagacggagatgcaaaacggcggaggctggaacgcattattctggtgcaaccatgaccagccgcgggccgtatccagatacggagacgatggcgtataccggacgaaatcagccaaaatgctggcggcggccattcatatgatgcagggcacgccttacatttatcaaggtgaggagatcggcatgggcaatccgaagttcgatgacatcggctcataccgcgatgtcgaatcactgaacatttacaaaaagatgaaggaagaaggcgtgtcagaaaaagacattatcgccattttaaaagagaaatcaagagacaatgcaagaacccccgttcaatggaacagcgggccgaacggcggcttcacgacgggaacgccttggattccggcggcggatgattatcgggacattaacgcggaagcggctttgcgggacccggattcaattttctaccattatcagaagctcatcaagctcagaaaggaatatgacatcgtgactgaaggaacgtttgagctgcttgctgaagatgatccggcggttctggcgtacgtcagacacggcaaggatgaaaaacttctgtgcatcaacaacttctacgggaaagaagcggactttacggttccgcttaaagacacggacggctggcggtttacggtgctgctgacgaatgatgaaccgagggaagggcggccggaacgattgacgctccgtccgtatgaatcgatcgtttatcatctgacaaaagcgtgatacactaatctgggtggtcatgaatgaaagtgaataaatatatcacaatctataaagatatggtgcggcagattgaaagcggccagcggaaggctgaagacgttcttccgtctgaaaatgatttatgcgatcaatacggcacatcacgagaaaccgtccgtaaagcgctcaatatgctggcgcaaaacggctacatccagaaaatcaaaggcaaaggctccgtcatattagacagagaaaaaatgcgctttcccgtctcaggcctgatcagcttcaaagagctttcggaaacgctcggaaaagagacgagaacggaggttcaccgtctcgggctgatcctgcctccctcggaagccgcaaaagagcttggtacagaagcggatgaaaaggtgtgggaagtcgtcagatcaagacggattgacggagaacatattattttggacaaggattactttgtgaaaaaacatgtgcctctattaacgaaggcgatttgtgaagattcgatctatgagtatctcgaaggagagctcagcctgtccatcagctacgcgcaaaaggaaattgtcgtggagccggcgggggaggaagaccggaagtatttggatctcggcgggttcagccatatggcggtcgtgaaaaaccgcgtctttttggaggataccagcctctttcagtacacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagataaaaaggagagatcatgaatgtcagataaaaaacagcagatcatcgaagcgtatcaattcagacacgctacaaaggaatttgatcctgagaaaaaaatttcagaaagtgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgactatgtcaaaaaccacttgcgggaagtcaaaaaaatgccggaagatatgtatgaaggctatatcagcaaaacggaagacttccagaaaaatgatttcaatctgcttgaatcagatcgcgcgctgtttgactgggcatccaaacagacttacatcgccctcggcaatatgatgacagccgctgcgcagatcggcatcgattcctgccctgttgaaggcttcaactacaaagagatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttaatgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcagtaatcgccccaatcgtgcccatgatgatcatagctgcggtaaccttcacaaaatccaccccgacaaacagtgtgaatatgccgatatcccccaattcttcttcaccgaatccctgaatcgaagtatgttttgttacggacataataaaaaacagcagcaatgcaatggtcagcatcgcagaaataaaggcggttacggttttgacgtttcctccattaatataaaaaagagtaatgctgcaaatcacggcggaagagagcaatgttaaaacaatcggattgatatgcggatctgtcatgaaaataatggtgagaaagagaaccccgaaatttaagaataacgcaataaaagacctcgctcctttttttccgccgataatgaccattaatagaaataaaatcgccgcgagaattacgatgacattcatgagcttgccttctttcgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatgttggtcatcgcccccatgatgtcttttccgatctccatcccggaacgtctgagagcttgtaatgagatacccttgttttcttcatataatccgaagacagatgacgtcatggtaatggctacatccatgaccgctcccagtgatccgataaataccccggccataaacactgtgtgataagggcgggttaaatactgcatttcctcatatctgagacctttctctccggttgccagcatcaccagatacgtaatcagcagggaaacgaaagtgcctgcgagcgtcgcggctatggcggcgtatgttttcgcgtgaaaaccgctgacaagcagcaatgagatgaccgtaaagatgagaatacagataccgcagatgaaaattaaccctatattaggatgcttcctgtacaaatccaatgcaaacgacagtaaaacggcgttaaacatcaggctgacgatcgaaaagaagccttgttttttgccgacgataagcaaggtgaagatgaaaacccaagcgatcagcaaaatctgtttatcccgttttttatctataatgcttcccgatatatctttgtttgatggttgccctttatcaaaagaaacgaatacttcatcgccaatcgaatatttctgatcattcgctccggataaagaatactgattggacaaatgaatgagctgccctttctgactgccgttttcaagtctggcagtgatcgtctgattgaaaatcttatctttgtttttatgcatgtcctgtacgtcagactggtgttccaaagttgttttcgtcactctggcaatcggccgctcataaaaagaagcgttgtgagtgacaaaaatgagcgagctgataaaacaaaacgctgttatcacgtaaaacagctttttcttgtaagacatgcggattcgtttgtttcctgtaatcttcaaaaaaagtcctccaaacaggcggcgccgtgtaaaagagaggtcccgccgtgaagtgttaaacgatgcggatgcagcctttcgcgaataacgttcatattttatcactcggccgtacggctgtcgactcagagggggaccggcagaaaaagctctcctgatatcagatcaggagagctcttgggatgaaacgcccgataaaagcggtctttttatgcttcgttcactttttttgcttttcttctttggtacagatacagtgccgttccgagcgcgctgatgagtaatccggcaagaaggatggaatacatcgttgtggctgtatcaggaagcaggccgcccggcgatactccgtcctgcgcagggccggatgacggtttttgtccgcttggctgctttccggagccgtgatctccgcttgtcggcggcgcgctcttcgtgtttgcgtttaatatggtgtattcactgaaatgatttgtataacccgtgacgagatcgtgtgaaaccgaaccgttgtctgtttttgtatagacgttctttttccggtctacatgataaataccgggctgtttcgcctttttcatattctcaatgcgcagggtgagctttaccggcgctttgaatgttttgatgtctttgtttttctgcttcattgtaaagtcgtatacatttgaaagcgccgccccgctaacttttcctttcggcgccacgccgaatcgtgtatcagctgaagcggcgtttgccataggcattttcatgctgaacttgtcatgcaggatcgtaagggaagaatccgatgttctgtcctttaacaggccgatttgttttttggtcacgttgagatcaatcggctttttggcgccgtcattcttatcgtaatacacgatcggcgtgttggcgtttttggcatagacggcaaatgcgctgtcatcttcaagcgtccacgaaccgtttttttgttttgtcggcaggtacacttcctgcgcgcggccgtcaactttcggttccaccgcttttcccgctttttcaagctgctcaacgaagacctcatagtcggcaaagccaaggtcttctttatgggatgcttcgttaaagacggaatatccgtctccgccttcaccgacaaagttactggtggcgactctgtatgtcttcttatcagaaatcggctttacactgccgtcatcctgtacggccgaagcttgaagaacacggtgtcccggctttttattcagtgtaaacgtgtatgttaaaccggcaacttgagggaaggcgccgccttgagcctcaattccgcttaatccttgttccagggcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgccggccgtcaagtgcgaccttcgttgaaccgactttttcatttttaactgagacgagctcttttttaaacggatcaagctcttttttcagatccgggtcttctttcgtctgctcattcaccggcagcgcttgaagagaggattgttccggcaggacgacgccgtttttgtcaaatgcgacatcgacacggcctaaatattcgccgtattcttttgcctgggcgacgatggtcggctcttcgtttttgacaatttccattttatctacaagcgtatgcgtatgtccgccgacgattaagtcgatgccttttacttttttggcgagatcgagatcacgctgatgtccgatatgggtcagggcgataattttattgacatgttccttgttctgtatttcttttaccgtatcttgtgcggattggaaggcatcatgaaagacaatgctttttcccgggcttgatgtgacggacgtatcttctgtcgtcaagccgaatacggcgactttttctccgtttacatcaagcagaatatatggatagatgcctgcttttttctttttccctgccgtaaatgtgtctgcttttttcatgaatggtctgagttttgactctttggacacatcgacatttgagctgacgagcggaaagtcaggtgcttgaaaattgtatttcccggacgggtcagacgcgctcccgttaccgctcaagaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttgattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcagatttgtccctttgaccggaaggatggaccagttatgatcagcctgcggattaatcgttttctgctggatgatgtaatccattaagacctgcctgttctcatcggcagaagagtatacgattttgtcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgccagcggaaatgtttgtatagtagtttgagccgttccgcccgccggctttaaacggggcgcccgccgagaggataggcagatctttgtactccgtatccttcatcttattttcggcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgagcagcgcctttgtattcggcatcagggaaaagcccgtgctgatggcccgatacgatcgcgtcaattccgccgactttcgttgccaggtcaaaaacggcgttttccgctccggaagactgcgcttttttttcgatgccgctgtgggcgagggcgatgacgatatcggctccttcagctttcattttcggaacggttttctttgcggattccacaatgtcctcgacctgaacgcggccttcgagatttttcttatcccacgtcatgatctggggaggaacaaagccgatatagccgacttttagctgatgcttgccgccgttttcatccgtgacggttttgtcttttatgacataaggcgtataacggttttcgccgcttactgttttcacattggcgttaacgatcggataatcagcgcctttgattgtcccgtccaggaattcaagcccgtaattaaattcatgattgccgagtgttcctgcgtcataatgcagactgttcatcacttcaatgatcggatgggtttttgcgcctgaaatgatatcatttttctcatattttacggcgtattctccgaggggattcccctgaatcaggtctccgttatcgacaagcaccgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggaaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgctatctgccacggccctcagcttctcatcaacgcgaaagcattggacgggcgcaaagcgacaggatttacttcaatccgaatcgatatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgttgttttttgtgctgggaattggtgattttatgatgcagcaattgagccgcttcttttcccgactgccgcggaaaggaagaaacggttgtaagcggaggataagaaatttcagcttccggcacgttatcaaagccgacaatgtcaatatcttcgcccggaacgagcccggcttttctgatcccttgcatgacgccgaatgcgaccaaatcactgaagcagaaaatcgcggtcgggcgctcagaccggcggaggagctccgtcacggcgtcacagcctgcttcgcgggtcggcgcgctgtcaatgacatattcatttttcacttccagatccgcttcacggagtgcttttttaaaccctttcatacgcttcgtccatgttgatgagtgcttcacgccgcccagaaacgcaatctcctgatggcctttctcaatgaaatgacgcactgccttataggtgccttcctcataatcggctccgacaaaatcacagttggcatcggcaatctccctgacggcgagcacgaccggaatgtcaagctgctcaaggcgggaaagggtttcctcagccgtccctgaaaccggacacaaaatcaatccgccgaccctgtgctccagcatggtcgagatcagctgctcctgcttggcgacggaatcaaatgtcgtgcctaacagcaccgttaatccgacttcctcaagcgtattctgaacgccgatcagaaactctgagaaaaacgtattggaaatgtcagtgataatcaatcctaccgttgtggacgtctgtgatcgtaaattcgcggcgacccgatcatatacgtaccccagctcccgcatggattgcagcactttctcacgggtcgcttcggaaattcggggattattgcggacaattaatgaagcggtggatgttgagacgccggcatgttcggcgacctgctgcaatgtcacccggcgttttttttgctgtttcatacgtcgcattcctcacttggtttttattcgttacatccattataagcgttttggcgcatgagaagaaagagagaggagggggaaaaagataaagcgccggaagacggattgtccttcggcgcttctgtcacaataggttattcaaacatttgctctttaatatactgaaccggcatttcacggcctgtccaatattcaaacgccatggcgccctgccaaagcatcatgccgagaccgttaatggtcttgcagccggctgcttgagcttgttcaagcaatttcgacgtaacggggttgtaaacgacgtctgtcacaatcaaatccggacggagcatggatgtatcttcaataacactcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttccctgtgatatcgatgccgtgttcttttaagttgcggacgtatcccataccgtcagtggagtgtccgatcagtctgccgttttcattaacgactgtatttaccgcgccggtaaatttcgctgaatccgcgagttcatcgagataagggagaatgttcatcttgttcggcatcgagacattgaagcctctgacgtttaaggcgcgcattcccgttaccacatcttccagctgttcattgccgacttcaaacgcgaggtaagcgtagttcaatcctaattttttaaacgccaggttgtgcatcgccggagataaagagtgtccgatcggtgtcgcgaataatccgataagctgagtttttccgttaatccgtcctaattctttcttcatgatgtattcctccgttagtccattcatttgtttttcctcccgctttgagggcaaaaaacgctgattacatatgtttatttaaaatgctgagtacgctgcgcaattcctcaacgggaatctgcccgggcgctgatgcttctttgcccgctccgaacgtgcacgctgagccgaagacttcgccggccagccggctgatcaggcctgttcccgccattgacatcgtgatgatcggccggtctgcgtattgtgttttcatcgtgtgagtggcatccaataagacgaaaacatcttcagtgctttgcggcatcaccgcgattttcggaatgtgcgcgccgtacgcctgcatgttccggagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatgtgttttgtttcgatggcggttttaagcaattcaatgtaaaagcggtcatcaataactttatttccgccttctttatgggttctgaatgtgaaaagcagcggtgttgcgcctgcggctttccgtagcttttcaagcatgccttttacggcgtccaggctgtcaacatgctcgtatacatccgcccgccactcaatgatatccgggcgaagcctgttgacggcttcaatttcttcgagcagttctttctctccggccgccatcagcggcacaatgatcttcggaagcccttcaccgatgaccgtgtttctgattgtgatagattgcatgataaatcctctcccttaaaaaatagtcaggctttcatcacttgcttaaagcggattccgataaacaatgcgaggagggcgctgacggccgcaattccgatatcaagcagaaaaacaggcgtcaggccggcggctttggatatcgctcccgttacaagcggaatgacaataaaagataagcttgatgctatattaacaaaagatgtgattgtacctttatttttagggaataaaacagccataaccgtcatcgccaattgcagaatgcccgcagttgaaagtccgatgacaaaggagctgatgaccgatacggccggctgctgaatgaaaatcagagcaagcagcgcgattgccgcgatcacagggtacagcaccattaccgtaatcggctgaatcactctgtttaacagcacagccagcaataacacggacacaagcgccccgatgctgtaatagctcaacaatttgacggcctgcacctcaggcatgcccaaaacggattgcccgaacttaggaagccatacttgaacgagcataaacagcgccgttgatgaaaagcctaacagaatgatcgcaacgccttcgcgccatatcgacggctgtgatgtgaacgcgtcatcagacggagaggcttccgtccggccgccgtcttctttttgcttatgattcggaaacggaactttcaacagaaaaaagccgttcaggaagaaaataatgcccggtacgaaaaacgtccagccgtaaaacaaatgcctgtccgcaataaacgcgataaaaaacggaagcaccgtcgcgccgattgatacaaacgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccatacccctttattgaaccactgcctttctttgaaaactgtttgatacaacggttgcatagacaaacttgaataacgctgatatcacaatgagtatatcgttctactaaacaaaaaaagataagcggcccgctcatttagtatatcgttctaccaagttcacagttactatactccttctttttatatgtgtcaaaccgatgaacttttattttttacttttttaaatcaaaaaagacccgccgtttttcggcaggtctgacatgggtttatttcctgagagaggcgagctcctcggcaatggcctgcatttcactcgggctgaatgatgcttttttcatgaccatttgatgaaggtatgtaagatcttctattttttcatcactgaaatcttccgctctgatgacgccgacattgagcatgttgagcttttgcgaaatgtcttcaatcattttatttaacgtttctgtttgttggctcggcaaattcatgcatcctttcatgatcgttttcgtcccctttattctaacagaattcatttagaataaaagcttatttccacagccgcagaaaaattgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctgaaggagaaagggatcagcgcaagcggcatcacggcgaggcaggtcgggtgagtctgatctgaccgattttgattacgtcattgcgatggatgcagaaaatatcggacatctgcgcagcatggccggttataaaaaagcggcgccgcgtattgcaaggctgcttgattatgtaccggagtcagaccttgccgacgtgcccgatccgtattataccggaaatttcagcgaggtgtacgctttggtcgagtccgggtgccgtcatttgctggagacaataaagaaagaccatcatttataagggggattgaccgatgaagcagacacgcatcatggcaaaagccattctgatcggcgctgccgccggcggagcactgtccttattacataagccgacgagagaggcatgtttccggaacatggacgcgtgcaggcggcgtgcggcattttaccgaaaacatcctgaagccctgaagcagcaggcttccgcaaaaatggatcaagtgaaaatcttcgccaataccgtatcggaagatctgagttttttaaacgggcagatcaccaagctgaagcagacgacaccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttaatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcactgcttctgccggtgttcggcagagaaatcggaatgctggccgcggatttcatcggcgcctcggacctgtttttgcaggtgtggtcggttgtccgctggggtatcagtccgcttatccttttaatcgtgtttaccgcgctttacatattcgcgccgaataaaaagctttccctccgttttgtcctgccgggagctgtattcgcggcagccggctggattatcgtcagtatgctgttctcattttacgtcggcacctttgccaactacagcgccacatacgggagcatcgggggaattatcgtcctgatgatctggttttaccttacgggaaccttgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgaggctgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacttccgatggcaaaagcgggcaatatcagcgcgacggcatccacggatatgcctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaacgggccgacagcgaatccaagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagaagcatgccttgggaaaatccggagatggaaacaagcagaaccaaaataaagaagtacagtcgtgacatcgcgtatttctccttcttcagtatctttcttgatcgtacacggatttgccgcgtccggcaacctgaaaatgccaattcgggctgccgaggaagtgtaattgaaggagtttttgagaaggatataaaaagacttattcgaaaaaaggagccaggcagatatgaatcggatttttttctttacggctgcggcgggagtgccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggcaatgcggtagagctgattatatcgattttcgccttaaaagaagggctgacgggcatcgtgcttgcttcactgaccggttcggtgctcggcaatcttttgctcgtcgcgggattgtcattttttatcggcggtttgaaatacaagcggcaggaattcaatattcatgatgcccggcataattcaggcctgctgatttttgccattatcgtagcttttgtcattcccgaagtgttttccatagatatgggggaaaaaaacaagcttgatttgagtgtcggcatcagcatcatcatgatccttttgtacgtggcagctctttatttcaagctcgtcactcaccgcggtgtttatcagccgaatcagccggaggcaaaggaagaagaggagcagccagagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacactgattctgctgttatcctttagttttttcgcaatgccgtctgccggtgcaaagaaaccgtttaaggttcccaactctgttgtaagcatttcaaaggaaaatacgtatccgaatgcttcacaggaccagccgatgcttcagccgagcaaactggcaaaggaattgttagatacatccgagatcaacatcgaaaatccgcatctgataaaaatgctgaatgaatcctcggtttccggttcaccgcttgccatcggctaccgggcgacaatatttctcgggaaatgggcgctcggctatcaatcgaacgaaacggtcgccaactgggaatataaaaaaatcaatacgaacagagcggataaccggggcggacagcaaaccgcggttatctcatacgcccaagaacagcagtacaaaattaaaggcgggctcacagcgaaggtgccgaacgcagaagacgtaaaaagcatgatgatgcaaaaagcgatgaagaaaacaaaactgccgctcgcgtttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtgcaggatcacgtcacattcggttttcaaatgacagcgcagccgagataaataaaaaaagctgattccggttcgggaatcagcttttttgtgtgtgatacatttcctcaagcaattgcacattgttgttgtacagctcccgggcaagaacgcgtctcaccgcaaggcttgccgagaagtattctttatcttgaaccatgcctttgacggtaaattctatgcctctcgtcaatttgttcaggctcatgattccatgcacttgaaacggctccgtcgcattgagaaattcatcccgcttcagtgaatcgcgaagctcatcattgagcatgtcgcaggctttttctaagacggcatatacccgctcgggatcttctttataactgatcacgacggactcggtaatccgcataaaatcaatattatagttttgaagctgtctgacctcaccgtttgaaatggtaagcagcttgccggtccactcacggatctggagggaacggagcccgatttcttcgactgtgccgttgaacagattgttaatcgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataacgaaatgacgtaaaagataaaaccgatcgtcgccgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatatccgtaattgtcgtttccatcttctgttaacctctggcttttcgtaatgaaaaatccgtgtcctgataataactgtttttgacaaggacgttcggtccgaggcaccggacgtttgtgcagcggcagttcagctctttgctcagcttcgtctgtctccacttgtcatatgcatcgggaaggctgtctgttttaatattgccgagcggcggtgtatcgccgaaatccgtgacaatgatatttccgtcaaaaatgttgacattcaggcgggagcggccgtcagggtcgtttcgcaccgtaacgtttttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtccgcttgttcagcatcgtttccgctgaaaccattacgcctgcttcgaccagcgtgcggctgttttcaatcattttatcaaaatagcgcgcccgctgttcaaatgtcggtttcttctccatcatcgcaaatccgatgtcggcaaagtcctcgaccgttccccaattgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcgatcggcagcgcatccgggtctttcggctggagcgtgtacccgacggcgcagtgctcgcatctcatattgcacaaagtcgtcgttgtgaattcaacgttcgtcagtttcatatctccatactggtcgacatccatgtacgcttcccaaggatcgtactccggtgtaatcggacgcagtgctgtgttttgtgtcatgactatctaactcctttataaatgggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcatcggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagcggtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacaccccgaaagtgcttgatgtgttaaaaaaacatcacgtcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaacctgtatctccgtccgccgcgcggcgtattcagcgaatatgtcctcaaagaaacgaagcgtctcggctaccaaacggttttctggtccgtcgcatttgtcgactggaaggttaacgagcaaaaaggaaaacaatacgcctatgatcacatgataaagcaggcgcatcccggcgcgatctaccttcttcacaccgtttcaaaggacaattcagaagctctggacgatgccattaccgatttgaaaaaagaaggctacacgtttaaaagcattgatgacctgatgtttgagaaagaaatgaagctgccgcgcctgtagaaaacacctctcctggtaatggagaggtgttttgttatttgatacatttaatcaatgccgcccaatccaaatctccgcagccttgtgcgatcccgctttcaaaatggctcttcgccagttcggcaagagggagttttgcggaaacctgttctgcggcggcgagcgccagattggtatccttgagccctaaagacattttgaagccggccggctcaaatttctcctcagccatgatcgtgccgtaattttgatagacgggagagccaaagagcgcgttggcaatttctagaaattgtttttgttctaaaccgaacttatccatcattaagaatgattcagataacgcctccagcatagaaacgagcaagaaattgacgctgattttcgcggcattggccgtttttgtttcttcacccgtgtcaaatacttgctgactcaggatgttaaacagcggttcggcctttttcttcgcttctgccggtccggctgtgatgatgcgaagctcggccttctcggcggcatcggggcggccgaggacgggagcggcaataaaggactgccctctgcccgaatgtgcagcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacaatggcgatcttcatttgacagtccctccaatgaaaagttttccaccattatacatgcaaaatggttaatctgctgtgtataggattgccactttcagttcaggttctgaagaccatccggagtctgatgcggctgtccccttataaaatccggtaaatcgggttttgatgattgtttttgaacggggttttacagtgaatgtttttgatttgaatgtgacgtcctttatgttttctgataaatccggcgtgacagaaatggtttgttccccttttccgtaatgattgatataaagcgtgcagctcatgcccgctctttttcgctcaatcagatgactgcattcgctgcggtgcttcaaatattcgacagactcttcttcgggcgcgaactgttttaaggaaaaagcggcatattcggtggcaggactgataccggaagcggcccccatactgagaaagatcagaaacagccccgccgcgggaagcgtccgcctgaacgcggcggcacaccagattaacgccgcaaagtaaaggacgaccccgggaatgacggagatatgggctccgtcttcagaccaggaagaaaagccgagcgactcaaagatgtaatcagacaccgtacagccgttatacagcggggcaatggacataacactgaatagcaggaggacagaagaaatgattttgtgagaaaagatggtaacggcgcacacctctttacgtttttttccagactatcatgttttctcaaaaaaagaacagccggcagccgttcttacttgaaaatattaaaccagcctttgcgggcgaaccaaaacagcatggcggcgacaagaacggccatgacgcccaaaacgataaaatacccgtatttccaatgaagctcaggcatgttatcgaaattcatgccgtaaacccccgcgatgaacgtcagcgggataaaaatggtcgagacgatggttaatgtcatcataatggcgttcatccggtttgaattcagcgtcacatagctgtcccgcaaatctgacgtcatatcacggtttgactcgatcagctcggccagttttaacagatggtcataaatatcgctgaaatacgccttcgtttcacggctttcttttacatggtcaaggctcaaaatccggtacattaaatcgcgcatcggaatgatcgtccgcctcaggttcaaaagatcagtccgcaattcaaacacttcattcattaaagtgccgtaagatttatgtgttctgctgtcttcaatttcattcagccggtcttcaattttgtacagcacggggaaatattcatcgacaagctgatccataatcatataagtgatgtgccccggcccttttttggctaaccccggagaagcgaaaaaccgttctctcacccttgagacgccgggcgattcgtgcaaatggaagctgacgatgaaacggtcggactgaaaaatgtccacctcttccatttccagtgtgtccgggttcaaggcgtggagcacataaaaacggtagccgtcataatggtcgattttcggccgctgcatatgctgaaagcaatcctcgatcgcaagcggatgaaagtgaaaataatcccgcagcagctcggtttcatgcatctcagcgccgaaaaaatcgatccagtaccatgcgatgtccggttgttctgtacgtgatagggggatattatctaatatctcattatgtgttgtgattgcggttatatgtatcataaacaaccctccgcctgccattatatcatgcggcgttatgaagaaaagtatacgaattgccgcccgcccgcttcatgatatacttggacaaaaaggggtggagcatatgtggaaggaaaccgtttcggtcacgccgccgtatcattttgataaagtccttgaaaggctgtcgctcgatccgctgaatgcggtcgatcttcatgcaagatcaatcaaagtgccgctcagaacacgggacggcaaactgtccgtcatcacggttcaagcggaaggcaccgccgcagacccggtcttcctcgtcagcggagaaacggaccgcgaggagatgattgaacggatcaaacacatttttcaatgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgagccgaaaacgatcgcggcgcttgagtatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggccttggccgcccgaatctgtttcctttggcggatatcggcctgcaaaatgccatcaaacgccgcttcgcccttgaggataaaccgtcaaaagacgtgatgcttcaggtaagcagcgaatgggcgccgtatttaagctatgcgtccttgtatttgtggagaagtattgaatgaaaaacagctttgatcattttttggaaacttccagtgaaaaacatgaaggaaccgctggctgcatgttatactgaaaagatgtgatatttcaaatcagccgctttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaaaatccgcaagccgtctgaacaccgcgtcacgccgccatgcccggtctacgaccagtgcggcggctgtcagcttcagcatctggcatacacccagcagcttcgcgaaaaacgcgacatcgtcattcagtctctggaacgtcatacgagattcaatgtcgaagaaatgaacattaaagatacgatcggaatggacaacccttggaattaccggaacaaaagccagttccaagtcggacgctcgcaaagcggcagcatcattgccggcttatacggacttgattctcataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccattgtgacgagagtcggttttgaaacaggcgaagtgcaggtcgtgcttgtcaccgcgaaagagacactgccgaataaagacgagatcgtcaaagccattcagaaccggctgccggaagtgaaatcgattattcaaaacgtcaatggcgcgcgcacatccgtcattttcggtgacaaaacaaaagcgctggcaggaagccatgccattcaagaagtgctcggtgacgtgtcatttgaactgagcgcccgcgccttcttccagctcaaccctgagcagacggtcaagctgtatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacgggaacagccgaacactggctcccgaaatggacgaaagaaggcttccgtcccgacgtggtcatcgtcgacccgccgcgaacgggctgtgacagaacatttttagataccatcaaaaaagtaaaaccgaaacgcttcgtctacgtatcctgcaatccttccacactggcgaaagacttgcaggcgctgtcgaaagactatcgcgtcgaatatattcagcctgttgatatgtttccgcagacggcccatgtggaagctgtggcgaagcttgtgttgaaatcgtctaactaaaataaacaattcgtaatcagacctggatttcggtataaacatttccgatttccgggttttttttatgcgcagcctttgccctggctgtttatcttccttcttttctcggagatctttaatttaaactgatgaaaagagttgaaaaaacgtgtggaaaagcgaggagaaaacagccaattttgacctcgtttgtataatgacgatctggtttattgtgacattaatgggataatgtaaaataatttgatataattggtttcaaatgaagttgtaacattattcaactgtaaagtatttatcatgccaaagtaagtaggtctttaataaatgataaaaaggaggtgaaaccgaacgagagatattgggatttcaacaactgaacgaaggttctgaagtagaagctgtaaaaggcaagggtgcttactttcaataatcacagcggcagttggcatatcaacaactgtcgataaaagatcaaatacactaaaaaagcatgtttggtcgttatatataatatgaaagcctaaacaggaaaaggaccccaactatttctcttgatcccaaaaaaggaataaatatgaggcggaaccgcaagtgataacaactattacagtaatacctgcgatggttatatccttaataagtaattattgcgacaatcatgcttcatcatataatgatgttaaattgacactaggctaaaaagtattgcagaaaaggaaatggataaagaaatgggtaaagtatataaaagaagttggtttcacacggttttggcatttttaatatcacagctttattttaattttgtagaattaacgggatggggtcctaattatagagaaatgaatggattcccagcaaatatagctgaactggatttctttcaaacatatctttcattctatgataatccatggtttaatattgtcactgttttcttgggggttttcactgttatacaaatcattacaggtataacaaagaatatccgaaatgaaagcaataacttctgatgccttatttaatgatgaaagaacatgaacactttctaattaatcttatgaatgaagactgcggcacttagtcagcagtctattttattggttttggatcaggattatcgaagcgtaaccttatacaaatatatataggtgattgtataaagatattaacatacggggtttaaaagccgatcaacccttagtacatatactgtatagagccaagccacttgcggcgttggttatttctaaaccatgagcaaatccgaaaagatccagattgaagttcttgaattctgttaagttcgagtttattttcccatgccatcctctttactccatgtgattcaccagcggcaagttaaggctttttctttttacattcttttcagtactcagatataccccccagccccatttgcttaatcaacttatttcttgaaatttgttttatggtaatagggagaactcatatgatattctatttaggttggaatcctttttatccaaaaagagcaaaagtaaggccgctaagaaagatgaaggtcagcgctaatcttaataaaccacaatataaataaaaattaggtgtagataatcatcacactttttctctctcaaacccttttaaaggtgaaggagttgactgagttgatcagaaataaacgatatggggttaactatagcggtagtctattacgttaactcaattaatgtgttctactccagtttgcttttttacttttaacgtgtaaaaagtgaaatgttcaaaatttactatcgtttgataagaagtgctgacacatgctataagtgtaaaagaagcatggtcagtttttaattttgggataaaggtttcactgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattgggatggcggaattagggtttaagggcctggatatcaatatgggctgtcctgtccctaatgtggcggggaatggaaagggaagcggcctgatttgccgtcctgaagttgcagccgaattaatacaggcggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaatcaagaaacttcgtgacgagattgcgccggatacccttttgacgatcaatggggatattcctgaccgtgaaaccggcttgaaactcgctgaacaatacggtgttgacgggattatgattggacgaggcatttttactaatccgttcgcctttgaaaaggagccgagagagcatagcagtaaggaattgctttatcttttgagattgcatctggatcttcatgatgaatattcaaaagcagaagccagagcatataaaccgctcccccgctttttcaagatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcatcatccggcccggatttcggtttgaattccgggcctttttgtgtgcagcttttacccagacagatccatggccggtttcgtcatgcagaaataaacgaataatggtacattgatagaagatacatcataaagggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggatttcttcgtccggatgatactgttcccggaaattacgatgtcacttttggaaccggtcacccggagatcatggaagcggacgagctgcgccgtcaatttcatgaaaaaggcttttccgacgtcgaagagcttgtcatgcttggcgggaaaaaataccgaagcgttctaaacgccgtcatcggagagcatcagcatatcacctggcctctgtcatcgtataaaggcattggttacatgcttcaagcgctgaatcgggctgttgaagaaaaggatgaactgcagcgcgtggatatgaaaaaaagagtgtaaccactcaaacgccgtgatagactgtatgcggaagaatgaagcaataaaagatttccgaggaaataaatacgtcgatcattgtcaaagacagggtgatgcccggtcttttttgtatgccataaaacgagacaaagggaacggatcgagacaaaatgagacacctgtctcaaactgtctccattgaaaaaataaaaacattcattttacgggcttcaaaggctggcatgcttcttgcatttataagtgtgaaccctaaatagaaggaggcgcacaaaatggaattgttaaaacgagaaggcttgtcattaactgaggaaaaagcgctgtggatgtaccaaaagatgctggaaatcaggggctttgaagacaaagtgcatgaacttttcgcgcaaggagtgcttcccggattcgtccatttgtatgccggtgaagaagcggtagctgcgggggtgtgcgctcatttagatgatggcgacagcattacaagcacacacaggggacatggccattgtatcgccaaaggctgtgatctggacggcatgatggcggaaatattcggaaaagcgaccggactgtgtaaaggcaaaggcggttctatgcacattgcggatcttgataaaggcatgttaggcgcaaatggaatcgtcgggggcggatttacgctcgcatgcggatcagcgctcacggctaaatataaacaaactaaaaatgtaagcgtttgctttttcggggacggagccaataaccaaggcaccttccatgaagggctgaacttagcggcagtatggaaccttcctgtcgtgttcatcgccgaaaacaacggctacggcgaagccacgacatttgagtacgcgtcagcctgtgattcaatcgccgatcgggcggctgcctacaacatgccgggggtcacggtggacggaaaagatattttagcggtttatcaggcagccggggaagcgatagaaagagcaagaaacggcggaggcccgtctttgattgaatgtatgacttacagaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccttatccgaaagagtctgagctgttgacagacgtctacgtgtcatatgaaaaagggggaatgtgagatggcgagagtcataagcatgtcggacgcgatcaatgaagcaatgaagcttgcgatgagaagagacgacaatgtgcttgtaatcggtgaggatgtcgccgggggagcggcggtcgatcatttgcaagatgatgaggcatggggcggtgtactcggggtcacaaagggtctcgtacaggaattcgggcgcagccgagtgctggatacaccgatttctgaggcgggctatatgggtgcggccatggctgcggcatccacggggctgagaccgattgccgagctgatgtttaatgattttatcggaacgtgctttgaccaagtgattaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccggggctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcaaaggcagcgacatcacgctgtttgcggtcggcaagcaggttaataccgcgcttgaagcggctgcacagctttctgagaaaggcatcgacgccgaggtgcttgacccccggagtctgtctcctctagatgaggaagcgattttcacatcgttagaaaaaacaaaccggctgatcatcattgacgaagccaatccgcgctgcagcatcgccacggatattgctgcgattgtcgccgataagggctttgatttgcttgatgcgccgattaagcggattacagcgccgcatacaccggtgccgttttcgccggtgcttgaagatcaatatttgccgacaccagaccgtattgtcagcgtcacacttgaattgcttggcgagccggcaatgaattaaaggaggggtatagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcacattaaagtcaaagagggagaaggagtcccgccgggaacgcccatctgttatatcggggaaaacggcgaagaagtgcgggagaaggaggcgccggctcctgaaaaagcagggaaaccgcaagctgaacctgaacatattcccgctccaaaagccgggcaaaagcgcaaacaccgcgtgaaaatatctcccgttgcccgaaaaatggcggagaaagccggattgaaagtcgagacgctgaacgggacggggcccggaggccgaatcgtaaaagctgacgtcatcaaggcgatgaagacggaagctgaaccgcagtcttcggttcagacggcccagccggagggaaaaccggcttcagcgatgagaaaagtgattgcagaccgaatgcacaaaagcctgcaaaacagcgcccagctgacgctgacgatgaaagcggacattacggagcttgtaaaatggcaaaagcagctcgccgacagtgcgaaaaagcggagcggtgttaaactgacggtcacacatttcgtatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgcagggcgcgggaaggcaatgcttccggagatgatctccacggatcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcaccatgctgccgctgagccttacctttgatcacagagtatgtgacggcgccccggctgcggacttcctgaaaacggtcaaaacgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgctcggaggcacttgtctcaatgaggggtgcatcccgacaaagtcgcttttggaaagtgcgaatgtgctcgataaaatcaggcatgcaaatacattcggcatcgaactgccgcaaaacattacactcaattggaaccgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtaatcgacagcaaagatgcgctttctttacagaaaatcccttcgtctctgctcattgtcgggggaggtgtgatcggctgcgaatttgcctctttattcagccggtttaaaacgaaagtgacggtgattgaatcggctgaccggctgctcccggcagaagacggggaaatcgccgccgttttcgaagactctttaagagacagcggggctgatattcagacaaaagccgcccttcagcggattgacaaagaaaggaaaaccgccgtgtggacaaaagacggaaaagaaattgaggctcaggctgatcacattttggttgcaatcggcagaaagccgcgtttgcaaggcctgaatctggagcaggccggcatccggtattctccgcgcggcattgaagtcaatgaccatatgcagaccaatgtgcctcatatatatgcgtgcggcgatgcggccggaggaatgcagctcgcgcatgccgccattcatgaaggaatcacagccgccgcgcatgcctcgggaaaggatagcaaagtcaatatgcgggcggtgccccgctgtatttatacatcgccggaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgagccggaattcggagaaatcgtcggggtgtcaatgatcggaccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggaattgcggtgcattccgtataaccggaataccctttctcagatgagaagaggtatttttcgttgaaagcgctttacttttcccctacaatatatgaaaagatggtctgaacaggggggagcgaatacaatgaatgtcattcggaatgattttaaaacctggaagcgttttgtgaaagaaggcgtgctcgatgaatcccgtattcagaagcgggtggccgcctcatggcaccgctgcaaaaaagccgacgtcaacccttatctagaaaagggaccgaatgtaatgccggcagatcatttagaaaggcaggccgaaaagcatgcgttatttttagcggcctcaatgccgcacgcagaaagaatgaaaacggcgatgcgggaaatggaaatgatggttctcctgattgattcagacggcgttgtccattcagttgacggccacccgcgcaccattcatgaagcgaaccgcatcaatttcttaaaaggcgcccgctggacggaaacggccgtcggcacgaatgcgatcgggacggctctttatacaaatgaaccggtcatgatacacggctctgaacattattcgctcgcttctcatcaatggagctgttccgccgcgcccatccgttatgaagacgggcggctggcgggtgtcattgatatttcctgccccgccgcccgcgctcagccttttatgctcggaattgcctcctccatcgcttatacggcggaacgggagcttgccctaaagatcaaaatgacagaacttgacatgatcagcaaattcgccgggcttacccggtctcatgatccgatcgtgctttgcaatgaaatgagccgggttatcgctgcaagccgtcccgttcagcattttaccggacatatgctgcgcgagcttgaggaacagggctatcatatcaagcggacgaagcgggaggagaacggcttcacatgcgtttacttatccaaacgggaagaaaagccgtcgtttatatttcatggtgcggcaggcaaaagcccgtcatcccgacatatgcttgagcagctggagcttgtcgcccgaacggacgcaaccgtttgtcttacgggagaaaccgggacgggaaaggagattgccgcccgggcgattcataacaacagctccaggaaaaacggcccgtttatcgctgttaactgcggggcggtccccgaaaagctgattgaaagcgaactgttcggctactcggaaggcgccttcaccggggccaaacggaaaggacatagcggcgctttgcaaaaagccgataaaggcacgcttttcctcgatgaaatcggagaaatatcacactccatgcaggtcgctctgttacgggtgctgcaggagcggaaagtcaccccggtcggcgggacaaaagagattcccgttgacatcagaatcatcactgccacccacactgatctgagacagcttgtcgaatgcaaaaagctgagagaagatttattttaccggcttcacgtctgtccgatccacctccctccattaagagaacgcaccgaagacattcccggactcttccttgaatttcagcgaaatcgcgcctggcggggggagcttcctgatgactttttagacgtattaaagagccggaaatggccggggaacatcagggaattgtttaatgtatttgaacgtctttccgtcatgttcccggacggacggctgtcagggcgccccatcgcagccctgcttgaagcgtcaggtcttaaagaggcggccgagtcttatgaacaggaagaagcgtcctctgtctccatccgggagcacattcagaaaaacatcatcgtaaacgcgcttgaatcagcgaaggggaatgtcacgctggctgctaaaatggccggaatcccgcggagcacgttttacaaacgcctcaaaaaattcaaactcaccgccggacaattgtaagaaacaagcatacttctcttgggtgccggacacgttatgtgtgaggactaaaggaggtttgagacgtgaatacacagcgtgcgaaagacatttcggaatccgccgccatggcgtatgtgacgtatgaaggagtcccgatttatattcagcatgtcaacgaagacaaggaaacagccaggatttttccgatcggaaatccacaatttgagcaggaagtgctgctttctgatttacaagagcatttttgagaaggggtctgctgatgacagcaggcctttttcgtacctgtgggaactttcccgctttttgagaaaaataactaaaaatgatcaaatgatctaactccttcaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatatgcgatgcgcgcgctcgatgaacaaattccgctgaagtacggcgtggtcggtcaggaaacatgcgggccgggcggaatcgcatacggcatgcgctctatcggcggtgttctggagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcacggatcgagagggcaatgatttaatgccgaagttgaaagagcatgtccgtgaatacggctacgttccgaagacggaggccgaacagactgaagcaagctggaatgacaccttcaaaaaagcgcgcgacgtacaggcggcggatccggatacgcttccgaacacatatctgcaatattacttattcccggatgatatggtgaaaaaatcaaatccgaaccatacgagagccaacgaagtcatggaagggcgcgaagctttcattttcagccaatgcgatatgattacgcgcgaacaatcatcggagaacagtgaaattaaaattgatgatcatgcttcctatatcgtcgatcttgcccgggccatcgcttataacaccggggagagaatgctgttaatcgttgaaaataacggcgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcatttcaaaagctgtggcaggcgctgatcctgtcaaaaacagtgccgaatgcccgtgtggcaagactgattcttgaagatctgatggaggctaataaggactactggcctgagcttgatgtaagcccgtctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataaacatacgtgctaccatctcggtatcaatgacatggcgaaagcctgtaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttaatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtactggcgcaaacgacgccgtataatctttatgcgaccagcaagccggtgacgttaagcgataaaacggaaatcgtcgcatttgccccgttttttctggtgggcgaagcgttattccgtgcatatgttgattataaagagctcgaaaattttgataaatagcgggaggtcacgtgaaatgatgcaaaaagtccagcgcttcggcagcgcgatgtttgtgcctgttttattatttgcattttccggtattattgtcggtctgagcacgctgtttaaaaataaaacgctgatggggccgctggctgatcctgacgggctttggtatcaatgctggtacgtcattgaacagggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccggcatcaaaacgcttgatacgaatattatcggcgccatctttatttcatctattgtcgtgtatttgcacaatcgttattttgataaaaaactgccggattttctggggatttttcaaggatcttcctacatcgttatcatttctttcttcattatgataccgatttcacttgcggtggcatacgtatggccgatggttcagtccggaatcggatcgctgcaaagttttctcgtttcttccggggcgatcggcgtgtggatttacacattcctggagcggattttaattccgaccggcctgcatcattttatttactcgccgtttatttacggtccggctgtggctgaaggcggtatcgtcacctattgggcccagcatctcggggaatactctcaaagcgtcaaaccgctgaaagaattgttcccgcaggggggcttcgcgcttcacggcaactcgaaaattttcggcattccgggaatcgcgctcgctttttacgccacggcttcaaaggaaaagaaaaaaatcgtcgccggccttttgatcccggtcaccttgacgtccattgtagcggggattacagagccgattgaatttacattcctttttatctcgccgtttttatttgcggttcatgctttgcttgccgcttccatggcaaccgtcatgtatatggcaggcgtcgtcggaaatatgggaggcggtttgatcgaagctgcgaccttgaactggatcccgctggcgtcaagccacggtttgacgtatgtataccagatcatcatcgggctgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacggctgcggcagacgaaacacagcgggatacagccgctttgtatattgaagcgctgggcggaaaggacaatattacggaggtcaccaattgcgccacccgtctccgcgtcactgtcactgatgaatcaaaggtcaaaagtgacgccgatttcagagagctgggagcccacggcgtcgtcagaaaaggcagggcgcttcaggtcattgtcggattaggcgttccgcaaatgcgggagcgcattgaacagcaattggatcaataaggtcaaaaccttcccctccccgggaaggttttatctttttcgcagattattgaaaaaacggcacaccaaatttctttattcatttgccggaaaggcataaaataataatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggcgtgatgatcgggctgaccgctgtttcattcgcatcgggaattttaaattcattctactccgcccacatcagccaaagctatgcgtatgatacgcgaaaagggctttttcaaaaaattcaatccttctcttattcgacgtttgcgcaattctcatctacgtcgtttatcaccaggctgacaaacgatgtgacgcaggtccagaatatgcttttcatgagtctccggtttatgctcagggcgccgttaatgattgcggggggcattattctctcgctgaccgtcaatgcgaaactcgggttttttctgctgatcacggtgccggttttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtttccgcttttcgtctcgtggaagcggcgatgccgattttaatgctgctgatgaacagctgcattttgtttatcttatggttcggcgccaaaagcattgctcagggcggagcgcaggtcggcgatgtcgtttccgtcattaactatgcgacgcggattacaggcgcgctgtccgtcctgccatttctcattatggtattttcccgggcgaaggcttccggggaaagaatcggcgaggtgctggaaacagaaggcggcgagggaacggggcacgacccggcgcgggcgctagcaggcgggattgagtttcgcgaagtgtccttccgctatccggacatggaaaaagacgcgctgcatcacgtgtccttttcagccagcccgaaagaaacggttgccattatgggcgcgacaggttcagggaaatcaacgctttttcagctgattccgcgcctgtacacggctgattcaggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggaagcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaaaccgtccctcctgctgttagatgacagtacgagcgcgctcgatcttcaaacggaagcgaagcttttacaagcgatcagatcctatgaatgcacgacactgattattacgcagaaaataaccaccgcgatgaaggctgacaccatcttattgcttgaagacggcgaattgctggcaaaaggcacgcacaaagagctgatggcacagtctcatctgtaccggcagatttatgaatcacaattcggaaaggagggagctgacagtggagaaagacattcgtaaacctttccgatatccgaaaataccgctcaaatcaaatgaaggcggcagaaaacgcgcgaaagcaaaagatacaaaaggcacgctgcgcagaatctggtcgtatgtagccgaaaaaaaagggcttttaacccttgtgatcatcatggtagtcataagcgccatattcggcctgctcggaccgttcgtcatcgggaaagcaattgatcattttatcgtcggacggacgacggacggattggcgggtgtactgttcatactgtttgggatttacctcgtgcaatcattgtccttatggtttcaaaactattggatgatcaatatctcgcaaagcaccgtgtttaaaatgcggagcgagctgttcacccatctgcatgagctgccgataccgttttttgataaacagcgcctcggcgatttgatgagccgggttaccaatgatatcgaaaatgtcagctccactttaaatacatccgtcattcaagtgctgtcgagcgtcattacattcgtcggcacaatcgccgtcatgctgtacatgagcccgcttttaacattgatcacgcttttgattattccgatcatgcttttgagcattaaatggatcaccaaccggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcagggttttgggcgcagacaatttcgggattcattccgaaagtcatgaactctttaaacaatttaagctttacgattatagcggcggtcggcgggctgtttgcgctgaaggggtggatttcgatcggttccattgtcgtattcgcagaatactcgcggcagttcacgcgccctttaaatgatttggcgaaccagttcaatacgatgttatcggccatcgccggggctgagcgggtgtttgacgtgctggatgaaaaagaggagcgggaagatgaagagcatgcgacgcaccagccgatcaaaacgggagagattgaattccgagatgtctccttcggctatcaggaagacagcctgatcttaaaacatctgtccttcagcgttccgaaaggacagtcaatcgccttcgtcggaccgaccggagcgggtaaaacaaccgttacgagcctgatcgcccgtttttacgagcccaataacggaaaaatcctcattgacggaacggacatcaaaaaactgacgaggtccagtctgagaaaaaacatggggtttgtcctgcaggattcctttctctttcagggcaccatcagggaaaatatccgttacggccgtctggatgcatctgatcaagaggtggaggcagccgcaaaagccgccaatgcccacggattcatcgaacggctcccgaaaggctacgataccgtccttacccaaaacggcgcgggcatcagccaaggacaaaaacagcttatttccatcgcgagagctgtgctggcggacccggtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaacttctcagccagaacgggttttaccgggaattatatgagagccagttccgggaatcataggtagggaaaaagacctccgacagagtgcggaggtcttttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctacgtcatcgcgacgattgagcttgtcggcggggttctgatctttttcggtttggcgacgcgcattatcggcgttctgtttgccgtcacattagtcggcgccattttcacggcgaagctttcctcaccatttatgggcggatcggaatttgatttcatcttactggttgcgtcaattcacttagcgctttcaggaagccgtctgctttcattggatcagctccttttcaaatcaaaaaagggagaaactttttcagcataagaaagaaggcgttcaaatgaccggcattcatcaagatacagcaatcggttatgtcaaattgacgattaaaaatatggaacgctcgctcggcttttaccaaaatgtcatcggccttcaagtcatctcgcagacagatcgttctgcagaactgtcagcagacggaaaacgcgtcctgctggtgcttgaagaaaatccgagcgccatcgttctcccggagcggtctgtcaccggcctttaccatttcgcgatacttctgcctgaccggaaagaactcggcatcgcattggccaggctgattgaaaacggcatcgcgctcggtcagggggatcacgcggtcagtgaggctctttacttgtctgatccggacggcaacggcattgaaatatacgccgatcgtccccgcagcacgtggcagcgcgatgcagagggcaattatgtcatgcaaacggcgcccgtcgatgtggacgggcttttggaagaagccggagctgaacggaaaagccgtctcccggaaggaaccgttatcggccacatccatcttcatgtgacggatttacagaaagccaaagcgttttacaccgatatcctcggttttgacattgtcggtaattacgcgggaatgtccgctctgtttgtttcggcgggagggtatcaccatcacatcggtctgaatatatgggccggaaaacatgcgccgccgaaaccgggaaatgcaagcgggctggattattacaccatcgcgctgccgcatcaaaaagagctgtcacgtgtgacaaaagcgctgaccgatgccggctttgagatcgaagaaagagaagagggcgtattcgtcaaagaccctgtatcaggggcggatatcgcatttacactgtaagaaaaaacccttgccgtctaaccggcaagggtttttatttttctaaaggctcgggaaagaagaacgtcgatttgcaatatacacccggcttttgtgtgactgaagagagcgaacatctcagtgaggcgcaaaaatgacgcgtggagcccgccatcgccggcccgaactcagggcatccgctggattgaaaaaggtgtccgttcggcggatcagggagctgtatgggcagactttgaatagaaaaagggaagagccgcatccggtcacaagatgcggcttttcatatacaatttacaattgtgtgaaaaatgcccaaaataaattgtgcttcctgattcttcctgatatgataagccgaaaaaggagaacctccacaaatgaattcaaatgcagcacagacggaacagtctatgaagcataacggaaaccggatgacggtcaaggactttatcattcttgccaaaccggggattatcatctcaaattcactcgccgcattaggcggattttggatcgcgtggcttcagtcggaaaggacgggcggagggcccggtatatttgccgccatggcggctgccatgatcggaacggcgttagtcatggcgtcaagcactgtttttaataacttctttgaccgcggcatggacgcaaagatggagcgaacccgcacccgcgccagcgtcacgggaagaataccgccgacggtcatggtcctgtacggcacatgtctcggcgtatgcggattcatcatgcttgcttcgcttaatgtactgaccgccgttcttggcctgcttgcatttttgctttatgccgtcgtttatacgctttggtttaaaagacaatccgtctggagcacatttgtcggcagctttccgggggcggctccgcctttaatcggttattgcgcgctggccgggtacattgatatgcccgcgattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttttgactgcggtttcgctgctcgttcctctttatatagacgtcagcccgttttataccgcgtccgctctcctgctcggggccatctggctgtatcggagcgtcaaaggctttcaggcggcggatgacacgcaatggtcgaaggggatgtttttttattcgattgtttatttcagtctgctttttcttattttaatggctgattcgtttatcaatgtgattctcagaacgtaaacaggcggcctgcagatacagagccgccccgttttgtttatgcttttttgatgagagccaaaatatcttcaagccaggaaatataattccgttcccgctcaagcgcttttgtcagcacgagataatggccgaaatcaggagaagaaaatgaatccgcctccgcggacgatgtcagcagttcttgataactgttttccagatcggacaatttctcctgccgctttacgagctgatcggtgaatagctcatccgcttcttcctgcgtcaaagctgagatgaaataagccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgctcaaaaacgcagaagcgccggatgcttatcattgaatccgcggagccaaaatcagcaaaaatatgcagaaaggggttatcgaaacggcagcagaactggaaaaagcctttctcgtgtctttgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgacttatacgccgatcaatttgatcccgtgctgaagtacggcggcgaaaaaaagcgctctgacatgaaccgggacgctgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctccgggcagagacggcacaggtcttttatacggcggactccccgggctggtacttaaagtggttccggaaaaactcggactggattacgctgaaaaaaagcattctgcaattttgcggcattcaaaaagccgagcggaaccttttttctgtcgtcagaacgagcacacccgaactgcgggaaaaatggctgcgccaagcatacgccaaagtccggcgcgcttgtgaaaaaggagcggccgcatgcagataaaagaaattttcgtgattcgctgcctgtcctgtttaagtgtcgttctgcttcacgcagtttcaatggtgctgatgattcaggaagagtccttagccagtgccgcccatacggttgatgcgtttcggaccctgttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcatcgctggctgaacaacacatcccccgtgtgggtgatgtctgtttcgtttatcatcaacgccgtctatctggcttacttttccatctttcatccgccggcatcatcggggcttgattctatttttccgttcttttgggttccgtttccgggctgggtgttttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccatccttcttttatttttgatctgcacgctcggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgcttcggccgcctttttgatacgggtccgctttatccggcacgaggacggatagttgtacatcctgcatacaaagcccccgcctgcggctgttttgacggatgcatttatgacaaaataacgccatcgattttctcccctgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagggtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaaacatgtcctcctacttggacgaatcaccggagtggtgccggaatattgaggaaaagctgaaacgcgccgaaacggagcaggcattattagcgatatggaacgatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccagggccaccgtggcccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatattagagaaacaaccagatccgaatttgtcagagtgtaccggacagccagagcattcgcgctcagagcggcggaaatgaccggcatgaaggacgatattttcttcctgtatctgcatgaaataaccgatctgctcgcggggaaagagccggcggttgcgtcgattcaagcgagaaagcaaaactatgaaacctataaaaaactgccgccgtttccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgctccggaagacggtgattcttttgcggcgggggaaattttagtgacgtcgacaaccaatgtaggctggaccccgctttttccaagagcggctgccatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggcatcgtccagctggaaccgcggcagactccggtcacttctgaagaggaaaatggtaaactgatagaatagaatcatgagaaaggagccgcgcatgaataaagcagttattaacggggagcaaatcagaagtatgagcgacctgcaccagacattgaaaaaggaacttgcccttcctgagtactacggtgaaaaccttgacgctttatgggactgtctgaccggatgggtggagtacccccttgttttagaatggagacagtttgaacaaagcaagcagcttacagaaaatggcgccgagagtgtgcttgaggtctttcgtgaagcgaaagcggaaggctgcgacatcaccatcatactttcataatacgagcagcgggagagagacaaaaatggaaaaacaaaccctcagccatccgattggagagtatcagccggctgaatcgatttcggccggacagaaacaagaatggatcaatgcgctggaacacgctccggctaaactgaaccaagctgtcagagcgatgtcggccagtcagcttgatacgccgtaccgcgaagggggatggactgtccgccaagtggttcaccatctggcggacagccacatgaacggctatacccggtttaaattgagcttaacggagaatgaaccggaaatccgtcctatgatgaaaaaggctgggccgctcttcatgattccaaaaccgccgcttgcggggatgcgcttgagctgttaacgatcctgcacagaagatgggccgctcttttgcgctccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctgtcttagaggatgccggcttccggaaaaacgccaaaacagccgcagacacaatcgtgcataatgaaatgacggcggctgccgtataaagatggtggtagccgctggaaatgcccgcttcaatcgcatcagaaaccgcttttttgacggcgggaacggggattcggcttacctgctcctgcaacgaagaaagtccgccgccgatatcgggcgtttgcgcctgatcagcgggaatgccgcttttcgttaaacggtttttaatgtcctctccgatccggtcaaagcccgctgtaatgaagccggcatataaagccggagcgagcgtcagcccgacctgtcttacgagtgacagcgtgccgagcgctgttcctttgttttggcccgccgtttctgatacaagcacattcagcggagccccgagcagaaatccgaaaccgatccccgcaatgacactcgccgtgacaaattcccatttatccgtcacccataacggaaacaggctgaagcccgcaaaggcgatggcgcctgatacaaccgcggagaagaccggtccttttttatccgtgaccgccccgccgagccacgctccgatgcctgacgccaacgcaagcggcgtcatccaataacccgctttctccgccgatacgtgtaaatattgctccgcataagaaggaataaaaatgaccgcagcgagcagccctcccgataaaaatccgatgacaagcgtccattgaaacactttattttgcagcagcgagtaggcgagaatcggatcgcccccgcggtattcaacccgcttttcgaccttaagcagcaccagaaagagaagtgccgctcccaaaagatacccatacacctttacgtccattatgctttctgacagcttcgtcccatcgagattcgtgataccgatcatacaagataagatcgcaagagacagcagcattgtgccggcgagatcaagccgtttcgcctcaggctctttcgtttcagcgataaacaaaccgccgcacacaaccaaagcggcggcaatcggcaggttaatcaagaacagccaatgccacgatccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacaggccgacttccatcataaacagttttttccgcccgtatcggtccgacagcttgccgacaatcggcacactgacactgagtcccaatgtgtaaagggtcactccccatgatccccatgaaggagaaacatcaaaagagctgttaatcgtcgtcagagcagcggaaataattccgttgtccagcgccgccatgaacacaccgatcgtaaaaagagtgatggcccggctctggtttttttctgtttgcaatggatccggcatactgatcaatccttccttttttaattcacttcgaatatattattcacttcaagtgaattaaatgtcaaacaaaaaaaggccgccgataccggcaggcctttttcatctctatgcctgtttggaagaatcaagggctcttgccaagatggcaagtccttgattgaccgtttgtttttcttcagcggtcagcgtttccaatgaacgcttcaattttacatgtcctttttgataaaggctgcggaaaatatctttcgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagcacccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatctatattaaaagtattatttcctattgcagttttgcttttagtcatttatcagtccaaaaaggaattgacagacctttcttttaaacgaacgctgtatattattaacgggattgagcgttacgatttatttattctcgttctgctcggtctccttgccgtcagcgcgatgtccttttatgactttgtgctgaaacggacgcttcgcctcaacattccgagttggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgctgctcgggctgtccgtcttcagtatcctgacgattgcccgcattctgccggtcggtgagattacaggtgagaaaccgtggctgtgggctgtaatcgccggagtggcgcttattgtgccggcagccttaatcgccgcttggatcaacaataaaaaagctggcgcagaagatggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccggggggattcggttcgtttgaccttctgtttctgctcggtatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttggttttcatggcgggagtcgttgtgctggcatccgtcgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgctgcgctggtcggcggttttgtgttcagtttcttaaaaggattgaacatcagcgcgatctttattctgcctgtcgtcatcgtattgctggtgctgttaaagcggcagtttatcagagagcaggcatcgtatacgctcggccagatgatttttgccgccgctctgtttattatcgccttgtttaactacaatctcattgccggctttatttgggataaaatgaatcggctgctgcgccacgattatttcgttcataacaattcgcacattacatatgccacgatgacggccattattgttgtgccgctgtttttccttttgtttacggtcttttatcataaaagatcgaagccgatcggagaaaaggccgatcctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaataacaaatttgaccgcgaaggctacacatttcatgtcggggaaccgccgttttcctccgagtttatcgccaagctgaaagacatatcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacggtattatggacgcgctttttatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgtaaaaacagatcgctgtccgtcacgatgattctcgtcacccgcctgatcggaaaaaccaaaaaaagacgccgttaaaaggcgtcttttttttgaagaattaactaaaaattctaattttactctgttatactgaataacatgatcataaggtgaaaggaaggctgatgaatgaaacaggcaaccgtgtttaaatatgaagcgtttaccgatattcctgttttgggaaatcccgcgggaatcgtctttaacggagatgattattcagatgaagagatgcagatgatcgccgaaatggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggtattcttcccgcaaaagccgctgaacgaaacggccgggtatacatcacgctcgaacaggcacccccgcaatttctgccgtttacgggagacaaagaaaagcttgcggcctcgctcgggattacggctgaggattttcacagcgagctgccgattgtttacggatcaacggggatctggacactgattgttccgctgagatcacttcaagcatcacggaatatggtgccggacaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgcggcaatacggaggctctgaagccgaatgcctcacgattgaacaaggccaggaaatcgggaaagacggaaaagtggaaatcaggattacagaagataacgaaaagatgaaaatcgagatgacgggaacggccgtgtatgccgaatcaatcaattttcagcttccgtaacggtttacaaaagacggtcgtatccgttatattataaatgataatcattttcaattgaataggaaggtgaatcggcatgccgaaaaccgaacaacttcagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatctacgcagcaagcgaagcgggtaaagaaaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggtctggcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggtcccgatctttattcagtttatttccgtttggctgctctttccgcttttttgaattcaccggaataaaggacttcctgcatttttttcagattggctccctgctgatgtttttcgcgcttcttttccataaaagaagaccctccttcaaaacagaataccaataggattggcttttatttccgtttttatgcagataagatatcctttaaagccaactcaagttcttcatacgtaaattgaaaaccggatgtcatcgcctgcttaggcagggcgcgctggccttttacgatcagcaggctcatttctcccaaggccttctccagaaaaaattccggtacgggaatccaatgggggcggtgcaggacgcttgcgatcgtctttccgaattgcttcatttctacgggattcggcgatgtcacattcatgggaccggacaagtcatcatgctccgccgcaaaagcaataagttccgcggcgtcatcgacatgaacccatgacagccactgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgacggcgcttgcctgaatcaaagtccggggttttttcggctgctgcttcataatccgtctgacttctctcgtcgcttctattctgcttgaaatgatttgttccttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgccaaaaagaaaaacgcctgaacatcggggcgggaaaggagaccgggatgccgtttattacaaaaatatcgacccaaaagaaaaataccgagcgcttcaacatctttcttgatgagaaatatgcattcagcgtcgacgccgacgtgcttgtgcgttttgacctaaaaaaagggaaagaactggacgagcttgacattcttgaaatccagcacggtgatgacgtgaaaaaagcctttaaccgcgccgtagaatttttatcatatcggatgcggtctgaaaaagaagtccgggatcacctgaagaaaaaagaaacaccggacatggtcatttctgaagtcatccataaactgtacgattaccgctacttaaatgacaaagaatttgccgaagcctatgcgagcacccacaaaaaaacaaacggcaaaggccctgacgtcctgttccgcgagctgaaagcgaaaggaatagacgacgataccatcaaggagacgctcagcgcgtttacatttgatgagcagatacaagaagcgctgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcaattgacgatattgatcaattcttgcaggaagaggagtaaactgaaatggacaaacgatacagtcaaatgacgcctcatgaactacagacagaaattgcgggactgacggaaaaagcgcgtaaagcggaacagatgggcattgtaaatgaactggccgtgcttgaacggaaaattacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcaacctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgttatgggtattctgacgtcgattgccgatgactttcatatacatgtatcttcagcgggcatgcttgttacggcgtacgcggcaagcgtctgcctgacgggcccgatcgtaactattatcgcggttaagctgccgagaaagccggtgctgctagggttgatgggcatcttcgtgcttgccaacctgatgagcgtctttgcgccgaacttcgccgtgctggcgatttccagaattttatccgcatccattcacggagctttttttgcgatcgccatggtgtttgcgagtgaaatggtgccgcctgaaaaacgttccgccgccgcggcttccatgaacggcggattaaccgtggcgctgatgctcggcgttccgttcggctcttatttaggggatgcccttaactggcgggccgtctttttcattatttctgttttaggcctgatcgggctgatcggactgatgctggtcgtaccgaaccgaaaaccgaaagtgattccgatgctgatgaatgaatggagtgtctttaagcataaacaagtgattttttcctttgcgatcaccattctcggctactcaggcgtctttatcgcttacacgtttattgagccgattttaagagattcagcggggttcggcacagtcggcattacaggcgcattatttgcctacggtctcggcggagtggcggggaatttcttcgcggggaaagtgccgctcaaactgctgacgcgcacgatgatcggtgtgatgatcggcctgatcggcgtcttggcgatttttccttatatcgctgtttttcccgccgcagccgtttcagcgacatttttgttcggcgcatgtgcgttcggcacgccgccgcttttgcagaccaaggttatttcttcctctgaaaacggcacgacaatagccgctgcggtgagcgtttccgcctttaacctggcaaacgcgctcggcgcctggatcggcggtttgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcaatgtttcaacgtaatgctgatcaccgtatgtttatcgctctcagctaaggaaatattccgggtttccggtaccccgtctttttcaaaaacaacggcataggttcctttcgcgccgcttttccatgtcatctcgccgtggtgatcagtcttgcctattatctctccgcggtctatattcggctgatgatctgactccgccgctttcatcacggtaaccgtcacaccggccgccggtgaaccgtctgcattctcaacatggagcgtaacgggcagtgcttttttggcggcggaatcatccgctttgccgcatccgcataaaacggctgccgcgagaaagaagacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggataccctgtcacggttgaggaaagcccggccggactggaactgttggtcgtccgatagccgtaccagccgacagtattcccgggcgacccgtttactttgattgcgccgtagtcatagtttgtgtcaccgttttctgtccaccctttgacactgtagaaggtcttgcctgaataagagtcgtacgggtacgatgacccgttgcggccgggagctgccgtaattttcgatgcccagccgtttttctgatcatacacgcaatgtcccgccgtaacgatcgtgtcagcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggggatgtctgtgttgtttgtacaggctgattctgatttgcgtcaaactcctcaccgctgtttgatacagatgtctgcgggctgcccgctgcttctgctgaaacagcaaataatgaaactgacagtaagaatgcggtaaggctcagcaatcgttttgaaactgtcttcattttataaaacccctccttttttgtctaccggcttgcggtttaacatttaacatattatggaattaatttagcgttatgaccgcaagaggatgtttttttccgcaaaaaaaagaccgggtcattcccggtctcttacggtgtgtgttatcgtctgcctgaagctctcatgcgctcttgcgggtgcgaattaattgaaccgtccgctcgtttagaagcgtagtcatcctttgcccgcggttcgccttcaaacttattattgttctgattaggaaatccttttgctttgttccggaccatttgttttccccctcggccaatatcaaaaggttgcgccttctggactgaagacgtaaagttagtatatgcctgtgacaagctgcgtaaaagcagcaggttttcccaaggaaaggagacagagacatgaatacatatatcgacaaactgacgaatttgctgcttgagaaaaatgacatgctcagctatttgcaagcgcggacttgggttgagcttttatggggagatttcgaagcgacttacgcaaaagccggccgcccgtatcaaggagagcaaatgacggaacgcgtcgtcaaggaatggatcgaatcatacggcagcaagctccatatgttccaaagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcatcagacaaaaatagacaccgcagcagatacatatatcgtgaaagcaggagaacttaatgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagagtccgttaaagcgggtgaaaccgtcaatgtgctcggctgggggttcagccatgacggagggtttgaccgtaaatgggcgtacgtcacatacggcgggaaagcaggttatgtgaaaacggccgacttaactcaaaagtaaagattcaggcgggcgaataagcctgctttttttctgaaacctttcgcttttcctttcgtaaaagatgaaaaggagagtgacggatatgataatggtaatcggcggccttctgatggctgcggcaggcatttcagtcgcgttttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggatttgcggtcagcctgcttatccggcagactcagccgttcgccctgatcgttcaggccgtattgttgatcgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctttggcggtgctgctgcacgggtttccggaattctggtacggctggaagagtcagatcaaaccgctggcggatgccggataccatgttgtcgtgcctgatcagcgcggctataatctcagtgacaaaccggagggcattgaaaactataccattgatacgctcagagacgacattatcgggctgatcactcattttacagatgacaaagccgtcgtcatcggacacgattggggaggagccgtggcctggcatttggcatccacgcggccgcaatacgttgaaaaattgatcacggtcaatatcccgcacccggcggttatgcggaaggtcacaccgttctacccgccgcagtggaagaaaagctcttatatcgctttctttcagcttccggaaaagccggaacggagattgtctgaagacgattaccgcgtattggatcacgcgatcggcttatctgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttctgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaatcatacgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattttggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgcccttttaaagctgagtgaagggaaccgtttctcgaaagggctgttctgctggatcgggtttgaccagaaaatcgtattttatgaaaatgtcgaaaggaagaacggcacgtccaaatggtcattcagcaatttgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgccgtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggctgcggctgccgctcatatttttttcttaaaagagtggtcggcaggccgctatatgacggggtctggagacgggatcgcccaaatggcggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcagcgtgtgtgttccgctatttcgtcaaacggacggtgcctgcttttgccggcgccgtgttgtacggggtctcgattatctacttccggcatgaggtgtattgggactttttcactgacagtatggtgtggctgccgctgctcgtgctcggcgcggaaaaaatcatcagggaaaaaaagccggcgtggtttatcttcgcctgtgcgctgacattgatcaacaacttttattttgcgtatattaatctgattttcatcggcatttatatcttattcaggtggatgatcccccttgaaggcaatgaggcgaaaaggctcactcaatgcaggatgtttattctgtcgggccttctcgggttcggcataagcgcagtttcctttatccctgtcgtatacggataccttcataatctgcggccgccgtattcagagcaaattgcatggcttgatttttccgacaacattttattttcaagccggataatcattctgccggcggtttttttactttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgcagtactcgccgttctgctctattggagccaagtgagacggttcagcctggatatttctgatcaggccaacctgcctatcctgctccttctggggctgaccattgccgctttccttgcagcaaagacaagactgaaaggtgcggtgtccgccgtctatgccgtcattctcttgacggcggtgctgacggctaatacatatgaaaaatatgcgttatcagaaggcgggaagatttatacggtatcgcatacctttatgacgggtgctgactataaaggcaaagaacaaacagagcttattcagcgcctgaaagaaaaagaccctgatccgtttgcccgtttagattggatgaacggtgttttcaataacaccccgatcatttacgggttcaacggattcagcgtatactcaagcatactgaacagcaatctgctgtccttttactggaacgacctccggattgacatgggcagagaaagcgtcagccgttatgcgacattaggaaacagggctaatttatacagcctgctttacggaaaatattatatgacggaaaaaacaaacggggccggcgtgccgtacgggttcaaaaaaatcatggaatcatcccattatgcggtttatcaaaatcaatatatgcttccgttcgtacggacagctgatcgcgtatataacgaggacggtctgaaaaaagcgcccgcccttgccagagaacgggcaatgcttgacgggatcatcacggaatcaagcgcagccaacacgaaaaaagcgcctgaggcgaaaaatatgatccgtcaggcaaaggtaacggccgaccatgcggattatcaagacggcatcctgacggtaaatgaagacggcggcggcctgatcattacgccgcaagccgctaagatggacggcggcgattattacgtcagcttttatttgaaaaataaagcgaaggaccagggctttacattaaaagtgaacgattacacgacaacgagaaaatcgaatcaatccatttacaaaacaggtgtcaacgatcttactgtcagagtgccgaaaacaaaaaacatccaaatccgtctgccgaaaggatcgtatcagcttgacaggctggcgctttacgaagaacggtacgatacgctgaaaaacgcataccgaaaagcggaaaaagaaccgcgggccgatctcagatggcgcggaaatacgcttcatatctcgtatgaaaacaaaaccagcgcgccgtatatcatgcttccgattccatatgaaaaaggctgggagctgaagataaacggcagaaaagagcagattgaaaaagcggattattccttcatcggatttaaagcgcaaaaaggaaaaaacgatattcaattaacgtattacccgccgttttttaaacccgcggccgctctatcggtgatcagcctcgtgtttgccgcattatatgtgagaagacaaaaaaagcccggctcttaaacagagccgagctttaattttttctgcagtttttcctcgctgaaaatccagcccgtgtaggaagagagaagctctaaatcatgactgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcacgcggttgaatgtatccaatatcacgacatggccgtcaaggcttctgccgacataaaaggcatgggccgtcgtcacggcgatacgccactgcctgaatttcatcgtcggcgaaataatgatggtttcaatctcctcttcaatcatttcgcgcagccttcgctttatccgcagctgcatcaaaaaccggacggcgtaatatcctgcaaggatgatataaagcatcagaaatgtcacgcccggatgacctccgatataccacacggcaatcgcggccaaatggctgacgaaaataaacggatcaaaggtattgattaaaccgagagcgatccattttctcgaaaacgggcggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacattggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtttcagaggtgatgctgcagcagacgcgcgtagataccgtcattccttatttccggcggtttgttgagcaatttccgaccgtttcggcgctcgctgaagctgatgaggaaaaagtgctcaaagcctgggaagggctaggttattactcccgtgtaagaaatctgcaaagtgccgtaaaagaagtacatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcaccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaacaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaaaagcgtcagtcatagctgacgcgagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgcccatatcacgtccgacatacatataaaagacccctttcaacagatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgttattaaagctaatgtcggccagccggcaaaaatcaaagacatgttccgccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagattaaagatatgatcgacacggtggagtttttagtttcttcaaaagcggacatgatccgcggccagaccatcattattgacggcggacgctctctgctcgtataagttataaaaaaagatgaatagccttatcgtctcctgcgcattctaaagtgcgtggaggtgataacaatggcaaactcaaaatacagcaaaacagacgttcagcaggtgaaaagacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgccaaaacgacaaaacttgtgattcctctacagaatgagtcaaagggttttccggcgtaaaatcgaaatggtaaggagtatcaacctaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagccaacgaccggacaatggtgacggaatccgacggacggacgtgggtgacgagagagccggcgatctgctactttcatgcccgtcagtggtttaacgtcataggaatgctgagagatgacggggtacactattattgcaacatcagctcgccgttcgcttatgacggagaggccatcaaatatattgattacgatttggatgtcaaggtgtttccggatatgacgtataacattcttgacgaggatgaatacgatgaccaccgcaaatcaatgaattaccctaaagagatcgacagcattctgaaggagtatctgaatacgctgctgcattggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagagggggataaagtgtgggcgtaatcagacgctatatgcaatttgtaaaaccttataaaaaacaaatttttatcacagtgttaattggcattataaaattctccatcccgctggctctcccgcttctgttaaaatacgtggtcgatgacattattcaagggagcggaacggcaagcgctaaaacatcatcgctattcacgataatgggcatcatgttcgtgctgtttttaattctgcgtcccccggtagagtactatcggcaatacttcgcacaatggacgggcagccgggtgctctacgatatcaggggggtattgtttgatcatattcaaaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtcaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcagttgtgaataccattacggatttggcgccgctgcttgttatcgcgtttgcgggttattttgtcataaacggcccgcttacggtagggacgatggttgcgttcgtcggctatattgacagaatgtacaatccggtcagaagattgatcaactcatcgacgacgctgacccagtcgatcgcttcaatggatcgcatatttgaatttatcgacgagccgtatgaactgactgataaaccgaatgcattaaaagctgacggcattaagggtgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcgcagatattcgcgattatgaagcgagaagcctccgcaatcaagtcggaatggtgcttcaggatacgtttctgttcagtgagacgattcgtgaaaatatcgctatcggtaaaccgggagcgtctctggatgaggtggttgcggctgcgaaagcggcaaatgcccatgaatttattatgaacttccccgaaggctacgaaaccaaagtcggcgaacggggcgtcaaattgtcaggcgggcagaagcagcggatttcgatcgcccgtgtattcttaaaaaatccgccgctgctgatcttggatgaagcgacatcggctcttgatcttgaaagtgaacactacattcaggaagcgatggaaaagcttgcgaaaaaccggacgacttttatcgtcgcccacaggctgtccacgattacgcacgcggataaaattgtcgtcatggaaaacggcgccgtcgtcgaaaccggcacgcacgaggaattaatggcccaaggcggccagtacagacacttatttacgattcagaatttgaactgatacaaaaacgtatgccgtccgaatgggcggcatacgtttttttgaatgcaaaaaaacccggttttacggaagcaccgggttactcttcgtctgtttctaattcgctgtctttcgggtggtatgtctgaaaactcgtaattagtgtatcgagatgctccagctgctcgcggtattccgcaaccgcagccataatgctgagcatattgtaatcaagcagttcatcctcgcagttctgctggtttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatctcgttttcgtagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtagactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagaagttattttttcatatgtctgaacgcatcttcaacggcttgtaaagtggcgtcgatatcctcttcagtatgtgcggttgtgataaaccaagcttcatacttcgacggagcgagattgatgccgcgttcaagcatcagcttgaagaacttggcgaatgcttctccgtccgtattttccgcctgctcgtaattgacgatcttttcatcagtgaagtaaaccgtgagcgcgccttttaaacggttgacggtgatggtaatgccatgtgtctccgcatgggcgagaatgccttgctcaagtctggctccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaattcatttacctgttctaaaaatccttcttcaggttcaacgatgccgaagttgccgacgatcggctcgacgagaaccgctgcaatttctgaaccccatttatccagcgcggctttgtagctttcaatgtcattgaaaggaacggtaatgacctcattggcgatgcttttcggcacgccggcggaatcaggggtgccgagcgtagacgggccggaacccgcagcgacaagtacgagatcagaatggccgtgatagcagccggcgaatttaatgatttttgtgcggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttccgccgctgttttaatcgcttcagtaatatgcggatgggcatgtccggtaataatcggaccgtaagccgctaaataatcgatatactgattcccgtctacatcccagaaataagcgccgttcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacgggttcatgcttccagaaaagagccgggggataacggttgtaatcttaacgtgaattggatacgcttaataaaaaacccggaggtataagaaatgacgattgaaatcggacaaacagcaccggatatgaaattagtgaatgacagcggggaagaagtagcattgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgccgaggcgcttcgcgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgctttaccttccaatcctttatccaatgtaagcggctctctgcaatgcatgcacatatccactctgcccagaatcttcgtttctttctcgcaagcggggcacatcacccggaccgcttttgtggacagcataccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatcccccctctcgtttaactatagcacaaaacatatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtcaaacaggctgatgaacctctttttataaagcattatgaattcgaacacaaaaccgcttctttacatattgtaacggatgctctgcttcaggaatggattctgcttgggacaaatagaagagtcatagattggatcatcaacggcaaagtgctgtttgaccgcaatgaatatatttctgaactcaatgaccggctcagcacttttcctttcgccgagcggaaattaaagatcggaatggaatacggcaagctgatcagaagatttgtagaaggaaaagcgttttttgaagctgatcattttctggatgcatattatgcggtagtgcatgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggctcgaattattattcttagcaaatgattttctcatccattcaaaagctgaaatcggttctgcgcacctttttcaggtgatgaaagaaaaagaaatgtggcagtttggagaattgcttcagcaccctgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgctgatgcgcttcaccaaaaagctcacagcggcggagaaataaaaacaaaaaaacatttgacagcaaatcgctgaaatgttatactgaaaaagtcgcctcgagatgaggttgagatgatctttgaaaactaaacaagacaaaacgtacctgttaattcaaagttttaaataaatcgcagacgaagaaaaattaaaatggaaactatgtttaaggaacaaggtacagcagcaacacaagaaacagaacataaggttaatcatactcaaaattcacaaacaccgaacaaagatgctgttgtttctggagtaaaaacaggattaaatttggcaacaaaaacaggaaagtcatcacttcatttagtaaaacaatttattgaatatcgtaaagaaaaatcaagacttcaaaatgaacgttttgaaaaaattgcagaaacaaccgaactcttagaacgagaaaaaattgcatttttaaaggaattacaaaaagaacaggataaacagaacaaattacatgaaaaagaactgaaagaaaaactgaaagaaaaagagaaagaaatcgagagatttgacaaaatacaaaaacgttataaagaaagcgctaaaagaaaaaaattaaaatatcgttcatctacatttggcacacttataaaaacaataatgcttcttatagtgattatcggcgcttatattgcttatcaaaaatactctgtttatattcccgaagattggttaaatcatttcaaataaaaaagcttcctttaacaaggaagcttttttatataaccagtttcatcataaatagatattttgtcaaagaccgcaccagaatcgacaattttattaaaattagaatataacctaatatactccgatttaaattcttgctttgtgtttatatcagtgtatttacaatataaatataagccatcatagccttcctcttcgattaaattagtagtgattgagtaactttcaaattgttcatcttcaattggatttcccaaagtatttttattatctgtaagataccattggtgttcatataaattataaggatcattttccggaaatgttggtgtagcatggaaaattaaatgagcatgacatttattttggtgaagtctaatagcatattttttcattctttgttcatcctttttattataatattaacggtcaatttcattatcttctactgttctgtatttcccttttattttccgttttttcttcttatttttatagtaattgttatcattatcagctttcccaattatatcgaacagagaagttgcaacaccctcaataccgatatttgtattattttcatgtgggttttctatatcattaaattgattgtacttatggttttctaataacttatatctgcttgattgactatcatattctttgacaaatatatgatctttatcaccatacaaatgattcaaagtaacatcctcacctgttaaaatttcaactgcatctttcagagatatgttttcactcagtctatatttcaattttacatccttaaataaatcatcaagttgactacgataacttaacaccatttttctagctaattctcgtttttctaaagctacactatgtgtactaatattgacaggaattctattgatttcatcatttttccccaattcatatttaacccacttattgatgtttcgatcgttaattctgtaactatataagtttttgacaagcctattattcacttctataaatttatctttcaaggacatagttctcttcaaatcattataatatttttcaacatttttttgccctttgtaattttcattaactttcgcttttattccatctttaatgaatgactgtgaagcagaatatcttaaagttggtgatgtaaatctatcatgaacaatattgtcatgataaatataatcaaatacagaattaactttatttgtttctcttatgaggacaattttagcattttccaacaaatcatttcgtatactttgaagtttattaaaatcctcttgtaatttgttatattcttgaattcgattagaaacataatcattaaaatactcaggtttaaaaccgacagacatcgaaaaattgtagcctttatcatgagcatactcagtcttcaatacatcattaatataatgtttttttgcttttaatttttctttcatatcatctaatttcttcttaatattaccttcattaacctctataaatacttttcttgccacagcaaaatcaacgtccatttttgcacgttttcttataatagaatatgcttctttttcacgattagataatggatattcattattataattagaaataaaattaacaactttaatctgttcaggatttttaatttcaatattactttgagctttttgaatttcttcgagtgtagattgttcttctaaaagtaatgcattatattcttgaattaacttattttgttttccaaaataggttactggctcatactcttttccaaattttaaagcttcttcttttgctcttttttcaagataataagcttgtctactgagacgaagtaaaggcaattttgttaatccttgttcttcaaaacttttttcagaaaaccgtaaatcaataccgttttctttcattgttttatttaactctttcgcccagttctctctccattttaataaagtttcaggtttatcccaatcatttgtttttactgaaacagttacacgttgacctttcgagttaaatacaggattacccttagaatcaactttttgaactcgtttacttttactattccattgtccattttctttaaaagagcgcattgttaataagacatgagcatgaggattatttttgtcatccctatgtattgaaacgtccgcaaccataccattattcacaaactcattttgaacaaaccgtctaattaatttagattgttcttgttcatttaattcattaggaacacttaataaaacttctctaactaattgcgctttattatgcttttcaattttttcaacttcattccataaacgctcacgatttaaagcccaatcaggagcatgtgaaggttttaaaataaatgtttcaggtttcactttatgttttctaaatgttttaaccaaaccatcacgttcactgtagagactttcatcagaacgatagcttgcacatgcaacagcagaatgtttttctctatttttaatttttacttctaatctataataaccacgatcaaacttattatctgccattctcatgcaccccactttcttctgaataaaaagcccctgcgggtaacaattcaactttttgaaaaattgttgaattgttttcccagtcgcaccttcaggtgcgtataactgggcactcgattcctcatgacctattctaacattcattttaatccttttcaattgaatagttgctataaaataagaatcgttttataattggtaatgtatatatagtaatgttataaaatccaatcaaggaaggattgttaatctaattatggcaaaatcggcaatcaaaaaggcaacggtaaagaaacataataatttcaagagaaagatggaagaactacaagcccaatttgaacaacaacaaaacgagctatatatgagcttaggtaaaattgtttttgaacgttgggatattgaaaactggggaatagaagagaatccaaagaagttagaaatagttcttaatgaattggcgagcattgcaaaacaaaagtttgatgaactgcctgatgatgaaattgaagaaatcagaaattcacaacacaatgaagaaacaaatagtaaatcatccgattatcattcaagctaatatgaatcatcatgatttaactgatagtgaagttattgaattatggaaaaagcttaaaaaaacacaacaaaagaaagagcgaatactcgctaaaataaataatgaaaatcaaaaaagaagaaaagaacgtgcaaacagattaatacaaaaaggtgcgttactcgaacattattttgaaatcaaaaatctgagtattgatgaaacagaagaactactaaaaatgttttcggattttattgtttctaaaaaacctagtcatttaagaaagtaaaggagtgtgaaaacatatggcaactcatggtgaagacattaatgatatttttgataacttaattcaaatgatctactcacgtttaaagagaaaagcaattgaagacttacgaaaacaaaaattagaaaaagacctaaacttatcaaaaccaattcaaaccgatttaactaaaaatctaaaagataaaataaaaaatcaaagtcgagaagacaacttaaaggactatcgtaaattagaaagagcaattttagaatatgatctcaaattgaaatcaggatataaaccatcaaaggatgaaaaagatgaatatcttttgaacaattttaaacgagatatttatgcaacagaattaaatttatctcataaagagcaaattgaaatcagacaagatattttagaatcaattaatgataaagatattaataataatgaacttagaaatgaaacgatgaataatcatcaagaaattgaagacttaattaaccaagaaaaagttcttaattctgatcttgctcgtgaaattttaagtgagattcagcaaaaccaatctctaatgagttctgtgagtgattctgtgaaaaacgaagcttcaaataatatttctgcacttaataaaagctataacgatttaagcaaaggaataataaaaggaaacaataaaaccgctgtaaacaataccgaaaatatacgtaatgtagtaagtgatatttcatcaaaaactgataaaactcaatcaaaagaaaatgaaattgaaagaatagatttagatatggaacatgaattagaaagataaaaatttctgattatactacatactaaataagttgagtttcattaaccaaaaaaggacaaccaagttgtccttttaatcttttcatttcatattagtaaaagcatttataaaattattcgatttcaggatagttgtctaatgtttcattgagcctttttattagagatttaacatcttctttttcaaacactgcaaataactggtcacttttgaaaagtccatctctggttaggcattcgtaattcagctcaaagctatccccattttcaactgctttagacaaaatttcatccaattcaacactatcggttgatttgatttccaataaatcttggtaaagccaatcgtttgtttcagttatgctatcttctttaattgcaatttggaaaaatacatccggttcaaacttcgtatataagacacctctaggtagtcttataaattgcttaagattaataattctcattgtaatcacctctgtataaaattagaattccattaactatttggttatacgtaaaactccttatgtttactttcttggataagatattcttcactatattttagcaagaatgatttctgtttaataccttaactttacttttcataagcaaataattttataatagacaattcgtttcccctttcaaaattatatacaactaaaatatctttatttgtttccctttctaattctctttttaatttatttgtttctattttacattcgttaatgatctttattataatactttgtaaagttcctcctgaaccatgttcaaaaggtatcattttataactaatcaacctatttgcaacagcaatcatattaacctccaaattcttaactataatatgaaatagtttgtccttctctttcagctaacaaaaagacttcataagattgttctaaagtatattcttttaaaaatgtttctaaatcttgatattctaagtcttgcaatactatacttaaaaaatctttggttatctcaaaagaaaaatgtccatcttccccagtgttatatgatgatttaagagtaaccttttcatccaatgcactcattttttctcacctcctttaaatttggttttttcactttttcaagctcctgaacttcaattttcttaatgttatctatagttgttttatagatttgaagcgcatattttatggcttcattttgtgtttttttcggaagcatgggactgattttatttcttgattattatctgtaaatgttacgataaaatgctttaggtctttcataaattcatcaccttgtccatcttacaattatgtttagttaataaatgattcgatatgctgtttaatgtttcgataacagaacggtagtctgtttttttaaccaaaacttccatacggttttcaaggcttttgtttgcagtaaggatattatccttcattctttttttatttgttgcaacctccccaaactggggaacgctcacagcctaatgcctatttatactcgctgtgacgaggttaaaaaagagcttaaacaatgttttcatattgcgtgatcttaacaaaatttaaggaatttataggtttaacacaaaacacgtttacacttaaattataagcagcacgtttgcataaatcgtccttgcttaataattgattaggaacttcaacttggtatgcagactctttttgtcgagttgttataccataaaataaattaccggaatcatattcttttttttgaatttcaggtatgtataaaatcatgaatccctctccttttatttgtctaattcttaccttacttctcttatattatatcatgaatatatattgaatgtatagtaaaaggataaaaaataaacctttttaagatttttctttggatgcgctcttaaccatttcttgagtatctgcgcttaaattgacgtataaagggctaaaacacatgtctggcactttcctattcagacataaatgaaacgtctcagaacggaaataaagagcgatttggcaggtatacttactctgtaaaattgcattcacctacaaaaacccatttccacaagataaaaaggtttagattttttgagtgatgtgttcgcagaaaaaaatactacccataccttgtggtatgggtagtatagatcaaggagttttaacactaatttttttttcgaattcatctgctaaagtagtattgaaaaatcttacagcgtcaacaaaataataaactctatttttaaactctctgattttctcgaaatcatttttttcgttaactctgtttagaaattctaattcactattgaattgccttcttatttcatcatcggatagaataacctctctctcataatctctaaccggcttgtttgtttcatcatttttaactccaaacgcttttttaattattgcgatttgaatcattaccctcacactctgctctcttgtttgtaaaacttgggtatctaaatcaattactttttccattaactttttatttctcattttctttccacccttttatgcttaatatatgacccttacctctcttttattataccatgaatatatattgaatgtatataattatttaaaatgttcattctgtatacattaaaaatatattgaatacaaaaaagatagccttcgctatctcttggacattttctaatatgatttttcaatgccatgtttaattcataaattgccaaacaatacatgcaataagccaaccaacaaaaacccctaaactaaatgatttgatactaaaacccttcatgaaatacctactccttatatagtcttatatagcccttcccttcaacaaattaaaagggctatattaataattaatgttagttttattttaaatcattttcttgatctttaatcaatagagtagcatatctttttgtttcttttaaagtatccttcgctctcatacaatgcacttctaatccattacaaaaaattctgaatgctccccatgtctttactatgtgccaatttttatagacgtacaccctttgtttttggttattaggaaggttaatagtctttgtaacaaaaggcaaaacatctggtacatcttgaaccttattttgatactctaaagccttatctttttttattttttttctaaacttggttattttcttctctatatcttctatcaattccgacaatttaaacattaaacgatcttctctttcaatagccttattatacttagtcatattcatatttcctctaccagtaatagcccaacttgggttatttcccttatgtgctagatattgctgatagtattcaaagtattttttcttaaacctttgcaagtcagactttaatacaaagtgataatgtgggttatttgtttgacttaaaacctcttttacttgttcagtatgctttaaaaataaacatttcaattcgtagttgcggtcttttattcctctcctgaaaatccaacctgattcaaactctctatcaataatatcttgaggaatgatgtatttatcacaatcatcaacatctaccattggataacaaggattaactgatttttcatttgggtcaacatccgaaagaatataaccacttaaaaacttgtgggctttctctctatcttctgctgaataaatagattgtattaaacgtgtatattcttctaaagaataatttgatgccttctcctgtcctgttatatatctatagtaacgttgaacatgttcaccgattgaattatcttcctgcatgacattttgactaacctctaattcaccagtatgactagacccatcaagccatgtaattttaaatacagttcttatggaatgaagatcattttcattaaatatttttatgagcaatgactgagcttctttgaaggttttaatattcgtatttgcatatttgttgttaccttcatgacttataattctgatacccgaaacagcaattttggtttctaccataggcgtaaaatctgtatttgttaatctaatttcattcattaaaattacctccaaaggatctgctccttaatatcttaattagattatatcataatatatattgaatgtatatagatgataacaaaaaatatatacctaatatgcatttaatatatttaactaaagggaactcagagtaataatgtaatgaacatacatccagtatatatttataaacaaaaaaagaatgatggcattcaccatcattcccagtcttcaaaaataagttcaggtgacgtacataattccttaactaattttttgaatagtacagatttatctttaatagtcgatgaagtcaagaagctttcaaagttgccttcgaaacatcttccatcaaaatcattttgactattttctgtttccttgcttattaagtaatcgttcaaacaaggttcgtttcaaattgcttcacacacctctccacgataacagtggccggcgtaaacccagccaaattcagtccgttttaatgtagcaaagactgcctttccattaatgtgattatacggttcgcctatctgaatgcatccagatgtatgacacgccggaggcataacattcaaaaaatgattcaccatttcttgatcgactacatctccaacttcaaggtatttatgtaaatcacctttccaattttcataggtctttagattagtcaagttcaacaccttcactttcaatagattaggaacaaccctttatgttatatatattataacataatatatattgaatgtatagtgatttctataaaaatatatactggatgtatatcgtaggtgcggtagtttcatgcaatacttttaactattcacttaatatacatttaaaaaacaaagaaggtgatagtatcctatcaccttcacttagttatctagctgaatgtcttaggcgttgtcattcatatgtcctccttatcatccataagagggcttgacgtaattgttacttcaagatagctttcacaagcttcttcatcaaagaaatactcaacatcggctgataaaatgtgtgtgaaagtaatattcgtcgtcccttctattttcaaagacaattcatcccatagaggtaatacggccattacctctaaaaagtcaggaagctctttcaacattgtttctgcgtttgtgaagtctacccgtaatccgttttttgttctgatcgttgttttctccattttattcgccctccccttgtaagatatctcttaattgttcccatgctcctgactcgcttgtatcgtagacagtaattgtagggcttagaactgctttatgaagtgaattcaggcgcaagaagttgaatttcttaattgaggtaggtatttttttattgttccactcgatttcggttgtctgtcctgtaggtacttcgctatttaatgtccatcctttaacttctgttattttcgccattttttatttcccctctcgttcgcttttgttatatttattataacacaatatatattgaatgtatataatagatttagaaatatttattcaacatttattcaatatatattatggaaaactgcaataaaaaaagatagcttttgctatcccttttaatggtcaaccttttatctattcgttaaatctgcaaatcctaattccttcaagagttttgtaaactcttttggttgtatatctctcatatttcccaatgcctgaataacatcagtgaattgattcagtaccttaaaagcatcatcaaacacttcaagctttgcacttaatttattaccaaaacgaatccaatataatgacatttcaccctccacaccaccaccttcatcaaacattccaaaattcacttcatcaacatactctgaatcttttaaattagcttccgcatgtttcgattctgacaaatgataaaaacctcttctcaccatttaacatcttcctgcctttcgtttgcttttcattatattcacaataacataatatatactgaatgcatataaggaattaaaaaaatcattgaacatttacacactatatattattcatccgaaaaaactgtaatagaaaaaagatagctttcgctatccctcgttatatcttaatatgattattctgtgtcaggttctttcgaaattaacccatacaatagtttatacaacttattttcttcatcattttcatatgcatcttttatttttaataacagtttttcgtaattttgaatttccttttttagtctcttaacttcattaaataagttcatattaatttcttcttgagttaacgcccccatttcaaacctccttaactttatctctaaagatttttctagtaaacctatgaatacaaaatgtcacaagtcctaaagctatcatattaatgacagctaaaataaatgggttcataagtgggttatcatcctctaacacgaatttataccccctctttaaaaaagcatttaaaacagaataaaacacaacaaacagagaggtatacataccatataagcaaaaactaattctaaatactttagtatcagaatctttatcagcgtccttcattccccatacaaaagcattaagtattgataaaatccaagctacaacatataaaataaatccaattaaaatcaagtgattacctccatttccgaactaaaccaattgttatgacggagataataagagcgattatagaaataaccattgataaaataagcaccgcaatttcaactccttgatattttatgcatagtgagggtataataaacatatgatattggacaggggaggggatagcccccttaccccttagttgttgttagaaccttttcaccgttcctcgcggtgagggttctttttcttttcacgccttgacagcaacagattagcaaagttagttactgcaaccgtcaaattaaccaatgacgttaatagcgtgattagaagtatgttctgatccaataccatacaccccctttctattaggggtagagagtattataccctctataaatataataccataatatatattgaatgtatataaataaataaaaaagatgcgactttttttgtcgcacccttatagcttactcattgtcattgtttatatattcatctaatgcttcaactaatgtatcaacccgccccttaattttaacaggcttcttagaaccattcccaccaaaatctttatattgcttagctaatcttgtcatttcatcttcttccttcactttcaattcatccatgaaattgttataccatgatttgaatttatctgatgaaacttcatttttaattgcatagttagcaacattaaagagcataggcaagttagttggttttagaaatttcttgttaggctcttgaattacatcattaagtaaatcgagtgcagactttgtaacgtcaatcaactcttgacaagtctctttacgttctctcaaccctgcaacgtatttagaaacctctgttggcgtgaatcctgctttggtcatttcatagtcattatcatatagcatgaaaaattccattaatacttttaaatcttcttcattctttatttgattttcactaaatttaattttttcttcgaaaatcggatgacttgttaatactgagattttttcagaaagctctacacctaatgtcgctttagctttctgaatattagaaagttgtttccctgaatttaatcgaaagaaaatatcctcaatctcttcataagcaatatcctcataagagtaaagattaaacatacaatcttctatttcatcctttaaatcctcatttaattcttcaaataaacattctgccatattcatcccatctacttcgggagtatcttcatttaatacaaatttgttattcataaaattaattgcagtagttaaacgctgttgtccatccaaaatccaatacacaccatcttcttttaaagcgtaaaaaggaggaatgggatagccattagccattgagttgataaaaagagattttgcggatttatcccactgtccacctttacgttgaatagggtgatcaaatctaattttccctttttcaaacatttttttaaattgtttagctgaccaagagttattagagcgtttcgacttatccattttataacatcctttcgaattgactgttctgatttcttatctttaaatcaagtataacacaatatatattgaatgtatagtggaaatatcatttattaaaattatttttctagccaattataaaagggaacacgttcagattcagatgttccatccaaagcttcacctagtgccttctcaagatacttttctgttaacatatgttttcggtattcttcatttgtcatgtttgttaagtctcttttttcttgtgctgctataaaatcactattcctttttaaacctgtcaaaaaatatttaacaaagttcgtcataccattttctcgttgctcatctaaagtaattttcaactgttgttccaaggttttcttgttgaaataaatcttttcctcttcaattcctttaatgacaccaaatatgtcggaaaattttattttgttgttctctaaaaaaacagcacacgcacgtaatttttgatctgtgcaaagtcttttaaactctcttgcctgattttcaatttctcttaaatcagtttctgactctttatatctatttttttcgtcgtcatcgtctaaagaaatattattcaaagaatgtgtattatctttatgtgtattatctttatgtgtattatctagcttgtctattatattagctcctgattttgaacactcgaagtcggacacctgaaaatggacacctgaaaatgaacagtccaacaaaccttgatttaacgggcttttttggactgtgcgttttccagtctccaaaaaatcatccgatttcttttggactgtgcgttttccagtctccaaactagattcgtgttcgttttgcaatattgaaaaatcatgtttctcaagcacctgtattaattcggaaatttctttgctagaaaaaggggtatgtctgtatatgtatttatatttgtttttctttccctctcttcttctaaactgaagaaagtaccctttatccataagttcatttaacattctagaaacgggtcggcgtttatttttcttgaaagaatcatatagttttgtttttttgaattcataattttcagggtaggatattaaataacataacaatgccattgcttctaggctcaaatcttgtgtttgtaaaagttctctagggagcaattcataggaatgttcgaatctgttattatatttaatcacgttatcctcagaagcattttcagtagagctgtgtttatttcctatgaaagaaccaatatcaccggatatattagagatttcaattgaatttgtatcaaaaggaacaatatcgaagaagtaatgatatctgtacttttttccttcacgttgttttatttctttagcatagttacaattttcaagttcagtccatgcttttttaatactcgattccttattaaaagggtatctatgataaaggttagtttttacaatcgtccaggtatcgggcaaggattttaaattaagaagaaggccgagagcttgcaagctcatttcttttttctcaggagcttgaagtaactctcttggaattacttcatatggtgtctgcttagaaataattttgccgagatttatagcaagatcaatttcattagaagtttggttaatcataagaattcctccaaaaaataacattggtaggaagtataggagaaattataagtatttttgctctttcctatgtttttttattatgttaatctaaccataggaaattaatttttgttgaatattttctctatacttctatccatcaatttgtttgtcagatttggtcgtctactgcaaattgatgggcttttttttgtctttttttctctaatcatattctaacattaaaaaaaaggcatgcaaggaaataaagatacaaaaatataaattttcatttgtgaaatttcttttcctaatatataatagaggtgtatttaatatacattaaacgatttctcgtttcgtttccattatatatacagtatatattgaatgttgtgtattttcaataggaagaaggaatgaactatttataatgaatctaattgcgaatgtatactaaataagtgttgactatacatcgaatatatattaaaattgatttatggaatgaacaacgattacataaatggaggaatcatattatgggtaaaataaatacatttgcaattgacttaggaaatggctttgttaaggcgaaatctgaaaagaaattgattgttgctccgagttctatcgcaagagaaaaggatttagggaaatcaagcattgatgtatacaataataatggatcgtctgtgaaaatctttgatagcatcctgaaaaaaggtgtaaattatgtttggggagaaggcattaagaatgttgtcaattcctcaaataagttgttatcgagttatacctttgaaggaagatatggttcggataactataagttactagttgattttgtattaggtgatcttgcatcagattataaagaaaaacatttggaagtccgtgtgataacaggaatgccaagtgacgaacttgaacaagaggacagacaaacattagaagatgtattcgaaggtagccacgttgtgaaaatcaatggtgtagaaaaggttatagatgtagttgaggttaaagtgttagaacagcctatggggtcactgttccatcaattaattgataacaatcttgaaatgagtgtggatttcacaaaacgtattgctttttatgatttcggtgcgggaactacaattttagacgtgtttgaaaacgggaaacgtgatgaagatgaaagtataactgaactgcaaggcatgaatgatgtatataaaactgtaaaaagactagttcaaaaaaaatacggcataaaaaaattgactgtatatgaaattgaagaagcatttaaaaacaattttaacattgaaattgggtcaaaaacctttaattgtgaagaaatagctaaagaggtgattaatgatttcttggatactgttatgagtaccttccaaggtgtgttgaattcaagagattatatcgaaaaaatctatattactggtgggggattgaacatcgtaaaagatgaaatcggtcgattcttcaaagaggaagagagcgttatttatattgagaatagccaaacagcaggagttgaaggtttttataaattcggtgaagtaatgaattcttgggaagaagaataaaaacaacaaaagttcctgatttccaagtgtaagggaatcaggaacgttcattcaaaatattgttgattaaaggagacttatgtaatggcaaacggcggtaaaaaaaatgaaactaaaacaaaggttcaaaacttcacattagatttagaagcagataaagacgttatggatgcattaaatgaatggacgaaacttcgcaggaaatccgaaagaattagagaagcaattcgtttgttactaaagtatgatgaattacaaagaaatgtcgggatgaatcaatacatttcgcaagaaaatttacattcgcataatgaaaacgttgtaaaacacaatgaagattataatgagattgaagttaacagaaatgaaaatgaacagaatatttccaaggataaagctacaagtcaagaaaagaaaaaagcaactttggattccaatctttttaaacaaatgatgatggaaagagataaataaacatacaaaggagggattgggatgaaaacaatactaaaagggtttttttcagcaccagtattaatcagtaactttttccagtcttttttagggacgctttttggattagttgccgcatttattttttgtggaactgtatttccagtgattgtacaaggggtatttagaattcttttctttcgaacaggacttaatagtcttttgaatatttggtcaagtgttcatattgcgattgaattttattgtgtttatgttgtcttggctacattaataacaatattcccaatgttttcttttaaagggaagttaataaggagtggcgtttgaatgaagagaattattatgtctcttttaatagtgtcaatgtctcttatcttagcttcttgtaagggggatcggataaacattgcaggaaattggaagttgagtggagatactttgcatgaccctttcgaatttgtggaaatgatcgagtttaaaactgatgggaaaataataacagacagcaacagtttcccttatacagagtacgaattgaaacaagatagggatggtacggaaaaagtcatattcaaaggtattaattctaatcaaacttatatattgaataaagttaaaaatgattcgaaaaaactctacataacaaatagtaagcacacagatgaatttaaagatatggtcataataaaacaataaaaagaaaagtcaactatttatcaaatcggtcttggcggacaatgagataaggtgacttttcttttttttattctataactatagtataaaaatcacagaaatgcaaaggaaaaacctttaaactattgcaattaattgagtaattgggtaaaataagatatgaaagaatttgcttttttgtaaaaataaaataaagccttataaataaaggctttattagacgattttttacatttaagcgatgttttctgaaaattaaaggagagtggttaagttgttgctatgactaagaacaaggcggagtttatggttaaatggcatctttcattaaagggggaaatttaagtataataggcttgtttgttaagtcttgttacttacctgataatggaaggtggatttttggtgaagaagttaaaaacgtataatggaggtagtaagaatcttcattcattaactgtttatatgagtgatcgggcatatcttgcagttgatattgcttgtgaaaaaaataatgaaaagaaaacaaatttcataagggatcgcctgaaaattaatcgtcaattcctagaaaaagctcaacttgaattagagaaaagaccgtttgaagagattagagctgaatacaaaaggcgtaaacagtataaaagaagaaaaacaaaaaaaggttggtctacgactatatacttaccctctaaggaatatgttgctgttctctttgcaagttcagcaactaaaatgactttaacttcatatgtttcaaaaattttaagaattgaaaaggaatatttacttgaagctgaaaaaatgttagaagatgaccctaatatcattttcgagaggaagaaaattcaatgaatttgtttagtagtgcaaagaagctgtttgaagcattttttagtggattcagcggtcttttagtgagtgttttcggactgtgtatgattcttactatcatactatcagtatggggaccccaacataaacgtgaagaatttaaaggaataatgatttggtttattatcttattctttatcgcattgagcgttaaagttgtacttgctttcgtatcaggacatagataaggggtgttaatgataatggattcaattaattctagtgttaaaaatttagttattgctagacaagaagaattagaaaaagaatttaaaattgaattaccattaaatattgacccttatagatacctattcaatttcagagtgattgatttacttttcctaacgccattcatcatcttagcgatgttcttagaatggcaaatgtttaaaataggttggctaaatagcatgacttttgtattcccactaatacctgctgtattagtgggtgcttgtcttttaataaaagaccctgataggaaaaacatttctgtgggtaggcgtttattatggtcaatagatttttcgaaaagggagaaagaatttatgtttgataaacaggaaaaagatgatttctctaacgatataagaagtagattaggtgtgttcaacattacttcgggttgttatgaaactttagatgacagatacgttaaagttattaaagtttcaagtgttaacctagagacaatgccgaaaaatgataagagacgaactttgagccaatgggaaggttttttgcaagaagctgatgtagagtggtttccaataatggttggacaatacacaaaaccagttaacttgacaacatatctagcagaggtgagagaaaaaacgaaagacaagaatagaatccaaagaaaacttgcggaatcgtacattgaaaaagggaatgaaattcaaaaagataggacaatggtttctaaagatggctattgtattatctctcaaaaaggtactgatgaacaaagcttaaaagaattaaatagaaaaacccaattgataaaagggaaaatcgaggatatgcttcaaggtcgatacacattgaaagctaaaatactcgataatgaagaattatttcaactcttatatacaacaattgattatgaaaatgctcaagccaacattgattatagtgatgattataattttggcgtagatttaagtatatctcaagaagaaatgattaatctccaacgtgaaaaagaagaacttgaaagaacaagaattttataaatttttgttcttttggtataaatgttttttgattttttgaaaaagagtatttaaaccaataaaatcatagacaaagaatgtgattttttattttgaagggtgtgtttttaaattatgaaaattccttttttgaaaaaaaagaaaacccgcattactgcggaagaatcgtacaaaaaattaaataccaacattgtgaacaggattgctccggacagtataactgaaacggaagacaacattatttcaggagggaactacactcaaacactcgttgttgttgattatacatctgtattaagtcaagaaaatatacaaagattaacagaccttaatgaaaatatctccattgttcaatatattgatttctttgaaacttctaaagttgtaaaacaacttaatgttgctattgaacaaaatgaaatcaaagaaggttcaagttattcaaagggagttactaagaaaagggcagaagcagaaaatatagccgcagatatgttgttgaataacacagttttcaaagggaaaagaatgtttctattccaattgcttatacattgtgttgcaccgagtcaagaagaattaaatagggttgtcaatcgtgttaagtcagaaataggttctttcggaaaagcgatttatccaagaaagaaagctaaagatgcttttgatagcatcttaccattaaacaaaaacaaggtttatgatcttacctatcgaccaatgtcttcacaagctgtttcttacgcttttccttggcatgagaatgagatttatcatacaggcgggaagattaaaggcaaaaatatgatgactggaaatattgtcaaagttgatgaagaatcactacttaataaacacagtgcttatgtagggatttctggttcaggaaaatcaacggcgatgtttacagacatgtcaagagattatatgtttggacatagaatatacactattgatccaaaaaaggattatggtgaaaagttcaaagcgatgggtggagagtggataaagtttggattagataacggaggaagtaggattaatgtcttcgatgttcctgctagggctgtgattgctgaggatgaagatagcgataaaatcaatgaaagtaacccgttgttagataagattactacactgactgtgttttttagactaatgtatcctgaaatgaatgcactgcaagagtctaccctaaaccaagctttaatccaagtttatgaagaaaaaggtattactcaaaatggtactgatttttcaaaattaaaaaaggaagactttccgattctacaagatttatacaatctaattgaaaactggaagcagaaagaccatgataggtatcaacttttgaaagagtttcatcagattctctattcatattgtgaggaaggtctttataacaatctgtttaacggacatacaaacgttgaactggaaaatgatctaatagattttgatatatcagccgtatacagaattgaacaagttaaaaagttgatttactttttattgttatctcatttgaggtatgaaattttaaatggtgatggaaaagctacgaagctttacattgatgaagctcatattatagctgatccgaaagttgttgttgcaatggaattccttttcgaattaatgaaagtagtccgttcatttaactgtggtgtcgctgttgctacacagtcaattagtgatttcttatcagcaaaaactgaatttaggaactacggtgaagcagtgcttgaccaagcaattcaaatgttgatactgccaatgaaacgaaaagaagttgaatttgttaatgaaactctgcaattaggtctaagcgaagaagataaagatttcctcactctctttgaagccacaaagaaagatcaagcagggaaaggattttattatttaggaagtaacaaggtgaaaatagaagttttcctaacaaaaatagaagaagagctgtggtttaaaaagaactatgacctatttgacgatgtggtttaaataggaggaatctttcatgaaagatttatttaatggtataagtcaactcctgttgttaaagattctaggtgttgttggagttgtcttgatcgttatagtccttctgtttgtttcttcaatgactgtgatgatgaaaacaggtcatgacaaagaagaatcagaaagtggggcaataaatggcggtgctgtgtgtaatgtaagtggtgatttagacaaggctaaatttaactcgatggttacaaggtctggagctataaaggacaaagggcaagtaattatagacattgccaaagaagaaggcatagaccctgttttaatgttggctatcattattaatgaaacaggttgggggaagagttcggctattgttgaacataataatcctgcgggattaatgcgtggaagtacgattattcattaccccactttagacgatggcttaaaagcgcagggaaggactttgcataatctaattattggacgtgggctaacaacaattgaaaaattaggttctgcttatgcacctgtcggtgcggacaatgaccccaatggaatgaataaaaactgggttcctacggttacatccttcgttaaacaagcaggaggattgactatgaactgcacagctagtgataacacaaacattgaagttggaaagaacggtaaaatgagttacttcgatgatgttcttaaaatcatgcttaaatttcaaggtaatccctatgtttggggtggttctaatccaaagacaggttttgattgttcaggactaatgcaatggagttttggacagattggaattaatttaccacgaactgcaattgaacaatataatgcaacaaaaagaataagcgctaaagatgcgaaagcaggcgatttggtattctttagaggtacatacggttcacctactcacgtttcacacgttggtatttatgtagggaatggtaagatgttcaattctaataacagtggtatagagtattcagatgtaatgacaggatactggggacagcattcacctgaatttggaaggattaaataagtttaagttaaggagaaaatgatgaaaggaaaatcatacaagagtgtttatctaaacgttctattattcattttgtctgttgtattggttattacgacaatttattttagagccgaaagtaatgaatatatgagcaagtataaaaatgctgatcaaaaactcaaacaaacccaaaaagaatacagccaactatctaaagattacacagaactgaatcgcataaatggtctatcgtcaaaagaaatgaaagcaaaagatgttattaaaaattcctttaatactctttataactataacaatgagaactttgtaagtcgttttgataaagctaaaaaatacatgactgataaagtggtggataagttaaagggttcaggtggaatagttgaagctcctaaagtcgacattgaaaaaagagtaaatcaactcaaaatttatagagaaataaagaaagatcataatattgtggctcttgttcaattggagtcaacatacagtgtggatggaaaagacaatcctaagatgaatgaattatatcgagtgagagttaatttggatacaaacagagtagacacttttgaattattgggagcattaaatattgttaatgaaagctaggtgaaaagttaatgaaaacaaaaaaagtgaaggggaagattattgatcttagaaaaaagaaagacaagttcaagaagactttgttaaagaaattatttgatgatccagttaggctagaaaaaagcagaatgataacaaagtatggcttagatgaaggcgttgaaagagaaaatgagttcttagatcaacaccttgagaaatttagatttaaattattttctttctattgtctcattggaattgtcatattgtttctttttgcaaacattatttcattttggcttccaaggctaatataaggagcactcgaatatgaagagaagcaaaaaaagaataattcaaattatagcatttgttctactatgtgctttattttttgcgattatgcctaatagtaatgcttatgcggctgtaaaagatggagataaagccattaaccaaaaagagagcactttgaaaaaacaaatggaaaatgatcttaaaaagagcaaagatgatggttcggggattaaaaaaattgaaaaaggcaaggggaagttttacaaagcatataaaaaagaaattgaagagtggaaaagttcaagggagaagttttctggagaaggatcggcagattcagatattgatttattgaaagactttgattatgtaagaggtagttttgattgtggttggattgatgtaacctgccatataacaaatgtttcttatggtgcaacctcgacaattataaattggacaatgatacctttctcaaccattgtaatgaaaccgagtgatgttttgaataacgaaatcttgaacagttacaaaggtgcgtttaatgcattgaccaaaagtttactatgcttattttttatatatcaattgttcaaattgttaattatgagaatgacagatatacaaagtgcaactcaggagggaaatgagaaggttgtaacgtttattgtagctgccttcttagtttttacatatgatgggttattcagagggattatgaatatccaatatgtaattaactatcctcttttatacggtctatcagcaacggaaaatatcgggaagcaaatatctttcaatatgttttttatgggttctataaatatgacagtggttttcttagcggtggttgctgttctaattgttgttcttatcttgcagatgtattattctctcgctttaatcagcgttatgtatgtaactggccctgtagctgttacaactatgctgaacagtgaatataacttctttagcgtatggctaaaaatcttagtttcaaggctattaaccttgggtttacaggctttatgcattgtattagggattaggatgtttgcaaggttaagttttgaccctgtaacaactttaaccaattcattcactggtattgccttttttattgttgcaataactatcccttcgctacttggacaattcggtaacagttctggaagtgggcgtgctgtactcggaggtatgaaaacagcaacaagatacctgattgttaaaagataaatcgaatatacatcctatgcgtatacactgtacataggatgtatattgtggtataatgaggttaagtgagatactgatgattggaggatacatccttgcaaagattgattaacagatatggagaaatcaatattgtagagaataaaggaattttaaaaatgccatacacccgccttggagaagacgcgaataaaagcaatttatcagaggcttatatatatggaattaaaaaatttggtatgagtgacttaattatctattcaactgatctcagggataatggcaattattttgaaatggagtatgacctgaaaaataaaagacctttcattgatattcgcagttttcaatttgtgcaccaactgtcagtttttagctctattgttgaaattgggaggatggagaatttatcaaagcaacaagttctgtgggaaaaagaaaattttctttttgatacagacacagggaaagtaagagccttaatttttgaattcgataaattccctttatatattgtgaaaaacagctttgaaggtgtgaagtcacttatatttctagccttaacaaatttagaacgatttgaaggaaaaccacgcagaagcgattttatagatcaatcggataaaataattgattttgcaaacaaaatactgatttcaaaatcaattgatgatattgagaaggttatcgaacaaaccttggaatctgaaataagttttcttagagaaaaagaaaaggaagaagaagaaaaaaaaagcaaactcaaaaaaaagttattctctaaaaaaaaccaaaataatcctgaaagaacagattataaaagtcaattaaagaaaacgctcgcatcaaattcggtagtcgattctcaaattgctgataatcgctcattcagtgtaagaatggctgacaaaattctcactcctaaaggtcttatcgttttatttggcgttgcgagtgtgttactggtaggcgcatatattttacctcacttctatggaagtaatagtaacgctggagaagaagaaagacaaaaaatcactacagaaactatgaatgcatatagaatttacattatgggagataaagaaaaagcctatgctaaacttgatgatttgggatatggaaatttagatgaaaccgacaaaaagattttattgaaattttatttagatcaaggtaaatataccaaagctttagataatgaacccgattacgcttataaaattggtgacaaattagttaacgagagtaagaaggatgacttggaaaaaattgcgatggcaagcgatagtaaggttttgaattttgatttagcttcaatgaataaagaatatcaatctgttattaatcgagtaaatgacttgaaacatatcaacgaaagacgagctaatgaaattgtaaaagcatactatctgactaatcaagagactgaattagaggactttatttctgcaaaagaaaaacaaagtgaaaaagaaaacaacaacgaactattaaatcagataactgcattaagaacagttcaacaggatatgtataacaattacacttcatatcgagacttagacaaggattataatagcttatccaaagaacttgatgttgcaaagaagaaaaagaatacatccgaaattcaaaagttagaatcaaaaataataactgcaaaacaaaaaagagatgaagcgtactcacagattgaaaagggctatacaaccgtaaattatacggatgttcagtaggaggtagctaatggcgattttcacgctttctaatatgttagtattcttaggctttttgctggctataggcggttatgttatgggaaatagatataaaaaaattcattggctaccttatgaggttactgtgaatatttctattttattggtatctattggagttattatattgattgtcggttacattatttaactggaaggagagtatcaaatggaagaaacccttgacaagaaagagttgaagaaacaagaaaaggtaaaaaaaagaaaagaagatttacttagtggcagaaaagaacgcaaaagaataagaagaaacttaattattcttattgtgagtgttgctttgattataggcttaaccatatttcaacaaatataccttactttaaaagggttaccaactcattaagggagaatcaaaaatgttaaatcgtttctttgtaactggatacacaggtaaagatttaaaaaaaactatccaaggcgaaaaatcatatatgtattttaatataggatcaaaaagagactataaaaatacagaaggacaatatgatacagactggatttcatttgttgcatatgatgcacttgctgatttacttgatggagttgaaaaaggcactttgttgactattgaaggtcgaattacttcttttgataaagtcgaaaatggcaaggcgaagcaataccaagctcttgttgctagaaaggtcgattttttatcacctaaaaccaataatctacaaaaaggagcgcacgaataatgacgactttaatattagctgaaaaatactcgcaagcgcaaacctacaaaaatttgtttcaacatactgagccgaaaaaaggttttatcaatgtgaaagaccccttatttccgaaaggggcagttattacatggggagttggacatttagtcgaacttgctccccctaaagattacgatgaaaagtataattattggaagttagaagatttacctctattacccagtcccaatgaatttaaaatgaagttaattaatgaaacaaaagatcaattttatattgtgaaaaagctattggaagaatgtcatgatattgttattgctactgatgcaggaagagaaggagaattaatagcttattccattttgaaaatggctaaagcagatcataaaccgattaaaagaatgtgggctaatcaaatggttgagtctgaattaaaaaatgcatttaaaaacttgcgcaaaaaagaggaaacttatggttattatattgaagcgcaaacacgtcaatactcagattggttagtaggaatgaacttttccccattagtttctcttttgattaataacatgtcacatttctcaaagtgggagactttttcattgggacgagttcaaacaccaaccttatacatggtgtatgagttggataaaaagattgactcctttgtatcaacgccattccttgaactacatggaatcgcagagacagaaagtggaacattttctgttgaacttaaagatagagataggttttcttctaaagaagaactgaaggtttttttgaaatcaaatgggctgagtgaggggttaaataaaggacgtatcaagagtgttagtacagaaagaaaaaaacaatctgcacctccattatataatctgacaaatttacaaaaagaagcgcatgataaatatgggtttacagcaaaaaaagtattatctactttgcaaaccctttatgataatggctatgttacatatccaagaacagattcaacacatattggttcagaggaatttaaaggtgtattgaattgtagatcgtctgtttcaaaaacactaggaatagatattcagtggaatactgatgacccaagcaaaaaatatgtagatgataaaaaagtagaagaacattctgctttaatgattactgcaaaaacacctgattatgaggatttaagcaatgaccaaaaaatcatctattcattagttgctatatcaaatttgagaatgtttgttggtgaatatatatatgatcaaacgaaagtaactgtttcattgaaagatgctgaatttgtggcatcaggaaaaatagatattgaattagggtggaaatcactaaataattatctagtcccttcggaaaaaacaacaaacaagaatagaaatgaaaaacaagaaacaaagttaccaattttatttgataagatgcctgttgatgtaactttaaaaagtcattcaggaaaaacaaaaccacctcaaagaatgacagaaagtaagttactgcaattaatggaaaatccgaatgtcgagaacgagtctgataaaactattctcaaaaaaacatcaggtataggtactgtggcaacaagagctgatattatagagaaattgaagaaaattggatacttaacaagtgagggagggaaattgattacaactgaaaaaggaaaaatactctgtgaagcgatagagggaacattgttaagtaatgcttcgatgacagcaaactgggagcgttacttaaaggaaatacacaatggcaaagcttcacaagatatttttctaacaaagattaatgagtatattaaagaattaattaagacactgccatttaagttagaagaaaaagcaaattcattttctcgtatcaaggaagcacaactggaaaaagacacaattggtgtatgtccaaattgcggtcaatccatcataaaaaaaactcttgaattcaaaaaagaaaataagaaggtcaaaagtgttttttatggttgtacaggttttgaatcaggatgtaagtttacgattcccacaaaattctgtgagaaaacgatcactacttccaatgtaaaaaaacttttaactaaaggaataactaatgaaataaaagggtttaagggaaagaaaaatgagttcacagcaaaattaaagatagcggataaaacaacaggtaagctttcatttgatttttcaaaataaaggagataatgatctgttatggagacaaaagaacattgggaaagtctaatgaacaatatgccggaagatgtagagggtatagagatatttcgtagtgctgaatggggagaattggagaatggaataaaagatagtcaagaaaaagaaatggaattatctgaaaatgaaggacttaaagatgacatattactctaccctgtaataaaagaagacatcttaaaagcgtacttagaagagaatataagtattaaagatgttccagactatcagttagagatagaaaacgtaacatacagagaagaaaattcattgtatatcattgaactcaaggatggtggggaatttacagtttcccctgacagacttgatgataaagactatgattatcaggattatttaatctatttcacaaaaataccagaacatttacaatttcatgaaatgcatgaagccgaggatttgttaataaggtttaaagcaacagacattgaattgaaagaaaatattaattacttcaaaatagttgatcgtaattttgataaagaacctagccctgacttagaaagaatcacaatgcaaaatatgacaaatgagaattttgttaatgcaggaacttatttaaaaaacgaaatagagaaacaggatgtttcttatttaactaaacaagatattcaagggttactgtcaaatcatcttgagaaagttgaagagattctagcagaatataaaaaacaaaaaaatcagagcataccctggaaaaacaggttcaactcctttaaaagtaatttgaagaaatcctattttcaattccgagcaacaattagagagaagatacaagcgattaaaaatactcctgtgaatttgaagaacaaggcaaaaaataaaatcattgatagagtggtgtcagttaataataaaattgttgataagacgaatactttcacccgaaacatggaaatgaaaagacctgaaaatcaatcaaagtccaatattattgatgactataaaagggaatataaaaaacatctaattaacaattattttgggaacgaatatcaaagcgaagcaaacaaaatcttgataaataatttggacagtcagctcacaaacaaaccacatctttccttacggttaaggcaggaagcgataaatgaactaaataatgatgttttaaaagggaaagccgagaaccttaatattgatctccctaaatttaaagcatacttggaagataaaagtgaactactcactcatggactcatgtatttcgaagaatttcaacaaaaggaactgcttacagaagacttgaaatttaatgtgtatcaagaaccagaaaaaaaaatttctcaaaatgataatgtttctgtgaaaggttatcaggcgaatagtgagtctgaaataaaagcaaaagaattacttgagaaattcaattttatttctgtaggaaaggaaagttatcaggcgaatagcgagtctgaaataaaagcaaaagaattacttgagaaatactttaacagtcttgatatacaagaaaaagaaaaatacaaatttgattcagcaaagtttgacaaagaaactaataaattaacattaaattatgatagtattcgtgatcccggatatacaactaaacatttagaagttgatttgaaaagtggaaatgcaaaagaaattaataaatgggttgaggatgaaagaggaaattgggtaactaaaagcagtgttgaaaatacatttaatatttattcgcaattcaatgaaaaaggaaattcaaacaatcttcatgcggaaaaagaagaagaattagaaagataaaaaacgaggtgttataaatggtaaaaaaatatgtatggcatgaaatagcaggttcagatttaccccaatatacttatatccctgatgatatgaaagttttagcagaggaaaaggaagaaccattcaatttaaagcaaaaatatgttgcttggtttcttgataaatcagataaagacgaagtatatgtgccactaaccaaaagagaaggggtgcaataatggcagaaacagagtttagatcaactaaagaaaaactgagtgcagttcaagaaattttaaacaatggcttagatgacatgtttcaaaataatgaaagctttaaacgttttttagaattaatgagtaggtttcctcagtattctattaataacttagctcttatacatgcacaaaagcctgatgcaagtatggttcaaggttttaaacaatggaagaagcttgataggtatgtaaataaaggtgaaaagggattttatatttttgctccaaactttaaaaatcaaaaagaaacattgaaagatcaaaacggagaacccattaaagatgaaaatgggaaagataaagtaaaaataaacaaggtgttaactggatttgttccagttaaagtgttcgatattagtcaaacaggtggaaaagaattaccaagcgcaaaagattttattcatgatgtgaagacaggtcaaaaacagatggactaccaaaaactttattctttggttaaagaagctattcaacaaaatgcaaatgttcctgttgaagaccaaactttaacgccttatttgcaggaaaatccaagtgtgaaaggctattatagtcatactaataatagtattgtaatcagaaatgacttgtcaatagaacataaatttaaaactctcattcatgaatttgcacatagtcaattacatgcaaaagacagtccatttaaggatgcacctaaaagtgaaaaagaaacacatgccgaaagtgttgctttttgtgttagtaattactatggattagataccagtgattatagtattggttacatagcatactgggcaggggatttggataaagcaaaaaaaggactaaatgatataagaaacttggtggaaggcacagtaagaagtattgacagtcttatttctaaacatcaattagaattattaagcgagaatgttgcagaagaaaaaacatcttcaagcatttctgaggaaaaaactgtagaaccattgggaacagaagtaataaatcaaatggaaagcagtcttgaagtaagtcaacacaataaaaacataacacctgtaaacgattataaatcactatttactaatgcagttccaaaagaatatattgaaaactttattgataatatggacatggcaaccaatgaaaaccctccttattttgaaattttagataaacaaacactttcgttcgtaactggtcaatttattaaacaaagtcctgaaagtgaaaattatgaatttcaagtgcaaggggagaaagtcttaactggagaagattttgaaacaggtgattatctcataacaaatgtgctatcaaatggtactgatctcaatatcaattctaaagattttgatagccaattctttatagaaaaagaggacaatgcttataacatttcagtttacaaggcggatggcattaaagaaatagtaggtaaaaatgatagttttaaaggtgatcaaagccttgatgttataaaagcgcagtatgactacatggctttagaaaaaacagctaatcaacttcaattcactgatacaatgatgaaacgaattgatttagttatggataaagtccatcgagatcaattgtcaagtgcatttgatgttcttgagcaaaaattgtttattgaagacaaaaacacattggatagacgtttccctgaaacgagtatcccgcatgatagaaacacagttatgttattaactgagtatgtacgagcttcaccattaacagattctttagaggacatacattcaaatataaagtcttcatctgaaaaagcttctcaaagactgggaatgaacagcgacatatataatttaatgttgactaatgcagttaatcaaattatagacaatacaatatccccaaaacagacattatcagaacaggtaggcaaggatacaattattcttactcgtgaaagtgaaaacacaagtggttacttagaaagtttaaagtctgctgaaaacgccattctccaattagggttctctgaggattttgaagcgaagtttcaaagacagtctatagagaaattagatcatttattagaaacacatcagctcaataatcctgttactatttcagattataaaaagattgtggctagagaggaagctacttcatacaaatttaacactatggaagggaaatccgtatccatagctgacaataaaggtttattcccttacatgattcaaacaaataatccagtaaacttaaaggatgttttatctaaaacaagtggagtgcaaaatttgtcccttcctgaaagagaacaaagtgttagcgatgttctcaattccttaaataaggatgataaaaaaaaagaatcagtagtggagaatgatagtgctgatttagtcagataaaagcacctatctgaaaggaagttttcaaatgatcaagctaaagaaacatttttatactgcgttgatacctattctcattttaacgggaataggtactcaccttatagctatttttttatatgtacttacccatcaaaaagagctgaataaccttgatgcaagtctcctttttagtaaaggtatttatgattttattttagttgacgaaaacggaaaaacacttcttataggcggaatggttttactgttctttacatcaatttatttagttcgacaaagtattttccaaaaaacatatagggatgattcagactttggtgttcatggttcagcgacatttgaagaaccaaaaagtttgatgaatggaaaagtattaagtaataatgcttcttactctaagttcccatttatcgggtataaaaaagtattaaaaatggaagaagggattgtactaggtaaagtgaaaagggacatattggttatccctgaagatactcaactacctaacaaaaacgttcttgttgtcgggccaccgggatctggtaaaggacagaccaatgttattactaacttagtcaacataagaaatcagagtattataaatattgatgtcaagggtgaaaactggtatctgacacatcaaattaaagtcgatcaaggttataaagttggaaggttggattttgttgattttgaaggttgggggttcaaccccatggcatttgtaaagaatgatgaagatgccgaaaaattagcaaatattacagctaagaatgctctctctgatgggaaagaagatttcttccaagaaagagcaagaactttgttgaggaatatgattatatacactaaaactcatttcagtcatgaggatgctaactttgattcactcttaacagtgtatgacacctacattgcagatgaaaagatttatgatttatggattcaacagcaagaccctgatgatgtaggggttcaagcattaaaaggcttttttgcttcccttaaaggtaaaacacgctcttctgtcaccagtagctttgacagtattgtatcagtatataagttaagtaaagtaagggaaatgactaagaaatcggattttgattttgaagattttgttaatgacaaatatgctctttacatcaaaatcgctgttccgagtaacccttataaaagtttaacgagtgcgttttttacacagatgattgatgcattctttaccattgctcgtaaaagcccaatttcagcgttgccaacgcctgttaacttgttgttagatgaatttgctaacatcggtaaaatcgacgcttacgctcaaactctagcgctttgtagaggatatttaatttatatcacaacaattattcaggatttaagtcagttagaaaaagtttatggaaaagatgattttaaaagtattattgctacccatgatactaaactgatactaagtgtaagtgaaaaagaaacagcaaaatattttagtgaatattttggtgaaacaacagtcacttataacgaggttacagggacaggaaacagagctgaaagtaaaccggtaacagtaaaaaaaccacttgtcacagttaatgatttaatgacaatggatagaaaccaagcctatgtccaatttacgggttttaatgtttgtaagattgagaaggcttggcagtttgaaatattcggcaacatggttactaaaggaaaaaaatacaattacgataaatttagaagtcgtattgtgaatgttgatgaacaacctttatatcaagagaacattgagacaagagaagttcaaacctttactgatatgtttaatacgaaaaaaaatgtcgtacaagaacatcttcaagaagtagataaacaaaaagaagttgaacaatatcaggaagcaattagacagccacttagtcttaatgaagttaacaacgaggaacaaactgaatatgctgaacatcttgagaataaggtgaaaacaagactatctattatccaaggaatagaagaattaattgtttcaaacgaaagaattcaaaacaaagatttaattttgaatcaattgaaagaaagtgcagaatctataagcaatggggaaagtgcaaaaattaagaagctcaataaaattaaagatcgaaatttaaagcatatagctagactagaagcgcaacgtattgagtcctctactgatgcagaaaatgatgataacgataacttactcaatcatattgcagaagaaactgagattcaaaaaacaatgattcatatgctagattctaacgataatctagttcatgatattattcaagaatttaaaaatgaaagcttagttgagcaaccacccaataataatgaagggactattgagagttttgtcgaaaatcatttttcgatgaaaactgaacccattgattctttccaaggtcaaacagatgatgatcaatcggaaaatgaggatgcagaagatgataacaaaacagaagatgacacaaacaaagtagcagtaggatttgaaataagtgaagacacagaagacccatttaaagggttttaaaagagctaattcagctcttttttttaattcttatatataaacactatacaaagaatatatattgatgatataataaaatcaaataatgcaaggaggtttacagatggagatttcactttcacagcatgagaggaactttatggttgaatggttaagcctcattactgaatacaaaaagtcatattgggagaagtattccgattctaatttgcaacacgaatttaatgatcatatcggattgtaccctgatgaattaaacgattaggaggaattaatttggaaaaaaataattcgaaaaggaagaaaaatagtcacgttttaaagattatgggaataggttttttagatatgttagcaaacggtattgaaaatatggtagattttgttacggaagcgtggtggcttgttgctttgggggtagggatatttagtttcaactttggttcactttatatgacaggtttttttcaaaatacggattgggatttcacttttatactatttctatggtttatcgttccttgtgggggcattacatttattgcactacttatcggttcttatataagaggaaaggaaattgttgaataaaaaagattcaaaagagttagattatttgagataatatcattatacaattattaggaaaggtggattacacggtgaatacaaaaattgcttttgaaccagtgggacaagcattaaatgaatggtatagaacaatcatgaaaaacgatattgacaaagcaaaaatgatgagagaagacattcagacaattttgcccgatatggaagagaatgaatacgttttgatctatttcaagttaatagacattcgtttgaaacttttgattgagagatacgaagaatcaggggatatactaggagaaatcagagagaaagcgttaagaacacctacagatgatataattcaatattattttttcttcttttctggcatgtacgagttttattgtaagaagtacaccaaagcaatcacaaattataaaatcgcagagaaaatgttaggaaagattcctgatgaaattgaaaaagctgaatttcactatcaagttgctattgcttactaccaaataagacaaaatttaatttctttaaatcacgctgagaatgcattggaaagctatcaagctcatgatgattatataagtcgaacaattaaatgcaaaatgctttttgcaatgaataaagttgacttgcaactatgggatgatgcaacacaattataccaagatgcaatacgattagccaagaaaagtcaagatcgtatttccgaagctttaggttattttaacttaggcctttgttatgaacgacaagagcagttaacaaaggcaaaatcatgttttgaatcagcagttgaaattcctgaacatcttgaatccattcactcttcaatacgttcaatgtacatgcttagtcgagtgtattataaaatgggaacgatcaataaagggcgcgagtggagagatattgctttaagaaatactgaaaatgtaaatgaagatgtatacaaagccaagttaaatattatatactttttgtatgacaacatgaatttgaaagaacttgatgttaatatgaccattcttaaagaaaagaaattgtggtctgacgtggcagagttgtctgaaaacgtagctgtacacttcaaaaagaaaaacgattccaaaatttcttcgaaatattttgaggaagcatcaaaagccaaagatcaaattttgagattaaccgaagatgcatgtaaactaaaggagaaatcttaaaattaatggagggcgttatgatgaaaaaagttactatgtgtgtggctgtgttaggtgttctattgttagcagggatttcagttcatgataacatcggagaatcgtctaacaagtttcaaacagccgaaaatggacatttaggataacttgaaaacctccatacaggaggtttttttatttttgcttgtccatccaatgattaattgcaattttgacattaagggtacttgccttaatgtcatcaaatattttcgaaacaagagcaaaccatgaaatttcctcttgatatggattgttttgattaatgaattttaaaatctgctttagttctttcattcgggcttggtctaattgagtatgcaaataacttttaacaaaagcgtttaggatatttgtgttacgtacacttacatctaaaagtattccagttgcttttgtaggagttacatccaaagcataagctaatgtacaaatgttttcatatgttaactgtgtgaatcgagtggtgattctctctgtttttcctgattgactttttctttgaagagattctttttcaagatcaccaagataaagagtgtttctgtattggaaatctcttctgaaatgctctgataaatgatcaataacatttttagaacgcaatcctttttcacaaatgatttccacaacatctttaattggaatgtcagtaatgaaagcaagacgttcaatacaacgtttaagatgcactgatatagtcggtttcacatcttttttcttgtcagatcgggtctttctatttttcgtttgagcactctcttccttcctcattcttcatccctcaattcgattttttgtttagaacagtgtcccagtgtcctagacttatttttatgtatatgggggaaaggggggaggtatgtttaaattttaaaaaatgtgaccatgctgatattaaagaaatttggaggggagaaacgttatgaaaatgacaaaagaaaaagcgaagtcttttgtgaaagatacgattgaacacagcaaaaagtatgggattcctcttaaaaagaaaaagtgaggttgcaacggtaaagttgcaatttttttatatattttcaatatacattctatatatattatgttataatatatatagaatcaagtgataagaattgagaaagaaaacacagaatgggggatattaaaatgaaaacaactcttaaacaattgtctcaaaaacaactttataacctaattggaagtacagttatattaacagaaaatcacaccacgatttctggggatagagttttaaagaaaaaaggatcacaagggatactggttgattatcaaatgttttggggcgaagccacgatccaatttggcaaaagaaattacaaagttggcatggacattgttcagcttttagagcaatcaggggagatcgaacaaaagagcagcgatgtatccaaaaaagaagaaacagaagaagctattgaaaaagagcacattttcaaagagacaagaacagtagaccaaattcttgatgaacataatgattatatgactttgtatagaatctttaatgatgatgcttatttagaaaaagcaagacaagcgttacgacaactttgagttttaaaagcaaaaagtatgggattcctttaaaaaagaaaaagtgaggttgcaacggtaaagttgcaactttttatatgctatcactatacatttaatatatattataatataattaagacagttaaaaaaaacgaaagaaagtggtgggttttctatggcacttaatttttggtcagaattagaacaagaaatacaaaagagggaagaacaaattcttaacttcaaaactttgcttgatacagggcataccacttttttaaaacctaaagcaaagcaagaagcttttgttcatgaaagctcaaaagaaaatgaaatgttacaattttcttattttgatgcttatggggcagtaggtgattttgaagctagaacaacaaatgaaattgctataaaaatattagattatggatttgttccttgtcttaaagaagaatttaagtacacgcttttagctaaaaacaataaaaggatggagagagtataatggggtctgggtcaagattattgccatttgttttaggcatcataataacttcattattagtaactggtggaatcaaaggatatgatttttatgaggacaaaaaatttgaagatcatgcaatagttatcaaaggggctgtgaaaaacaaaaaggttaaagaacatgaagaatccacagtagactatataggaattccgattataaattcagaaacagttgttgattataccgtaacagttaatgttgatgaaacaatctatacagtaaaaacggatgaagatcattttaataaacttgaagtaggaaaaacagttgatttgaaaaaatataacggtgaagtaaagctagcccagtaagtcttatttttttacaaacttcaatatgtattcagtatacaaacgtgagtttgatgaaaaggagtgaagtttttatggaatacatcttgaaagctctgatctgttctatagtaataattttggcgtttggtggcatcttcggtattttgtgcttaacttctaattttatcggttatgaatttgtacccttggcaagtcttatattagtagcatttttttgttcgcttatttacttcatatttaatgacaaacataaataagattttgagaatggagaggtcaagggtggagcttagttctaatgttgaaaaaactgggttggttattttattgttattatttttagcaacagtggtatccatagggaatcatctttataaggataataaatttgaaaatcatgctacagtcataaatggaattgtaaaggacaaaaaagtaacagagcatcaagaacctacaatgggatatagttttattttaggatcggctgttatgggtttagaaacggatgtagattatatcttaacagttagtgttgataaaacccaatatgcaataaaaactgatgcatccaactttaataaacttgaagtaggacaagcagttactttgaaaaaatacaatgatgaaataaagctttctcagtaagttatatatttttttgctttgtattatgtacattgaatatatattatgatatattaaagggaaggaaagtggattaaatgaaagcaatattcaaattaagcttttatgaaatattcttcttttttgctttggtaagtatatcttcacttttcattttgtctattgcgtatttttcaaactagattaaaaataaaaagtctcttaggcgactataacctgtattaagcatcagcgtccccctaatgggggaggttgcaatatgagtggagtgaatttttaaaatgactagtgttttattatccttgctgtttctaagttctttctataatgcctatctgttgtacaagcagacacattacacagaaaaccatacacacaaatattttgtgaatgaaaaagaagtagtggatacattcacaattcaaaaaaaggggaagaaaacgtatttaaaagcaacacgaaataacattattaaaatcgaactttacaataaagggaaaggtgattaaggaaaaaatatagtttaatcaggaagttcaggaagttaaaaataaaaccaaaagaaagtgatgaagaagaacatgagacatattgaaaaaaatgtaatggatgctatatatcaattaaatgaggaagttgaaattctcaaaaaatataatgcaggggtaaacaccttagaaattatatcaataaaagctaatatgctttattcaattgttaccaatggggcggatgaagaacatgctccttgggattattttaaagcgaaggatgtattagaaaaaatcttagagtgaatgtgcagagttactatgaaattattataaatcagtgtagtgatgtatcaaaaaagatcgttgatacatctttttttacacatatttatatacattgagtatatattgtgttataatagaggtataattaagtgatttaagaattgagaaagaaaacacagaatggagagattgaaattgaaaaatgtaaacttaatgaccctagaagctgaaagagatcaagccaaaaaacaattagtaagtcaaattaaaacaataaaaaatataattgggaatcttgaaagaaaaatagagaataatgaaacgctttatgatgaagatggattgcagtctagtggagtatatctggataaatatttaagtaagctaacaacctatcaaagagcaatcgaacagatgactttagttttaaaagagtccgaataaaacgaatggatggacatggttaagaagttgaatgaaggacaaccgagccttattgatctggttaatcagcaaattgaaacatatgagaatgataaggagtgcaaggaatagttattagatagtcgtctgggcgactataaacaggcattaagccccgagcgtccttcctgcttcgggaagggattgcaacaagtatatcagatagggatgggtgcggcttggatagagaaaaaatcaatgtatataaatcagacgaaaccgattattgtgatggatgcggatacagaagattaaagggtgtctatagcttatacgtgccgtatgcaacaagcattgtgaatgtgtgcgatgactgcaaagaaaagctaatgaatgccttgaaatctgaataaaacagcagatttattgaaaagaggtgtttaaacagtggatatttttttgtcactggttattgtcttaatggtactcttgatttgtgttcttactttagttttatttgggaaaaaataaaacagcggtttctttaaaattcatattttaaacagaaaggaagattattgatggggaaaaataaactatttagtgaggaaaccgtaactgttgacaattgccaatgcgtatattgtggtcatgtattcaatggtcgtaacgcttgcaacgctaatatggacgtacatactgttacgtgtccagaatgcaaaaaggatatggatgtttatctatctatagagtatatatgtagaccattagaggattaaaaacttagttcgtatatttaagataagattactcaaagagaaatagggtttatacaaggagtcgcttattcagttgccgcattgatgaggtatgatatggatgcaaaacagctgttacgacaatcaggaataacaatggatgaattaaaaaagtatgttgataatgatgtcgactacaataccatccttgagaatctatctggagaatttgatgggggttgcggataaattatgccaaaaaatcaatttgatttatatatggataaaaaactgaatcgaaaaatcaacgattatttcaatgaattaaatttagactcagttcataatgaaaaaaaagaacaaataatcaatctttcttcggaaataatgtacatatcatttacatcaattagaacgttgtcatggcagttagataaaagtgaagataacattttaaaagaattaatggtacagataattagtgaattaagtgattgctgtcataatttacccttatacattaatctattaagaaagggtgaaggtcatatgcacttaggctctgatttagctcgtgctgtttcaacattctgtaccataaaaaaaattttgagtgaatttcaattgcggtttgacctttatctgaataatcttattgagaagctccctgaattggagtttattgaagctaatactcaattttaatattgattttttaacattaatggtttgatgaaatatgagaaacggcaaaaaaatatgaatatttcatcatttaaatgtgcattcactatacaatagacaggtaaaatgatataatttaaagtgagtcattaccaatgggtatgatgacgagcttcattaacagtgaggggaattcacaaaagaagaggttgtgtataaacatatgtataacaaaaaaatatctgattttatccgtacttttgttagtgaaatacaaaattcgaatgcgggaatttttgcgggtgcaggattatctcaacctgcgggatatgtggactggagagaattgttaagagacattgcagatgaattaggacttgatgttgataaagaagatgatttaattgctgtagctcaatatcatgtgaatgaacatggtggaagaggtagattaaatcaagttttaattgaaaactttactaaggatgcacaatcaactcgtaatcacgaaatattatctcaacttccgatagatacatattggactacaaattatgatcatttaatagaggatagcttgaaggctgaaaataaaattgttgatgtaaagatgacacctcaaaatttagctattacaagaccagcagatgctatcgtttataaaatgcatggtgatgttcagttgtctgatcaagctgttcttacaaaagatgattatgaagaatacgaggttaaaagaagtctatacagtcagactctgcgtggagaattgatttcaaaaacattcttatttattggttttagttttgatgatcctaatctatcttatattctaagtagaataagaatactgttagggcaagacgccagattgcattattgctttatgagaaagatagatagggagaaatattcttccgaaacagaatttgcgtatgaccaagttaaacaagaattaaagattaaagatttacaaaggtataagattatagttttattggttgatgaatatgatgaaataactgagattcttgaaaccataaattatttagtgaaaactaaaaatatttttatatcaggaagtgcaattgattatggaacttggggacaagaaagagcatttaaattcagtacaaatttaagcaaagagataattaaaaaaagtcataatattgtatcgggttttggtttaggtattggaagttgtattgtatcaggagctttagaagaattatatgattctaaagctaaaagagtggaagaaagactaaaggctagaccattcccacaagcgacgacaggaagaatggaaatatcgaaactatggacaaaatatcgtcaagatatgttatccaatgtcgggattgctgtctttatgttcggaaataaaaaacaacatgactctgaaaaaataatagacgctaatggaatgattgaagaatttgaaatttcactgaaaaatggtattgttcctattccaattggggctacggggtttactgctttgaaattatgggagagagtaatgagcgattatgacaaaataatcggcattaaatcactaaaaccttattttgaacaattaggagatacaaaaaaatcagatgaagaattactttctttaacaacaagtttaataaatgaaattataaaagcgaaaataagtgagggggtgggtgttcatggctcgtaaaacctttatatcttataagtattcagaagctactgagctacgagataagattgttgaagcattaggtgacgattctaaatattatcaaggagaaacaagtgaatcacctgatctttctgatagaactactgactacattaaagctcaacttaaagacatgatttactccacctctgtaactatagtcattatttctccaaatatgaaggagagcaattggatagattgggaaatcgaattctcccttaaacaaattaaacgaagtgaaagaagatcaggaacaaatggtattgttggtgtagtaatgaaacacaatggaggttattcatggttaagaccttcaatagaaaattccgatggtcatattgcagttctcactaagaatgaatacttgtatgacattatcattaagaacaggttcaatcaagaacctccagaatatacttgtgatgtatgtaagaatgttgatatgttgacaggatcatatatctctttaattaaagaagaggacttcttaaataatcctaataaatatattgaaaatgcttatgaaaagagcaaaaacactgataattatactctgtgcagacaaaaataatctgattaaagggggtgattttgtgggtgaagatattttcagtaatattgctaaaaattatagtgatcaagattttcaaagagttcttaatagtgctaaatcgcaagaggttaaaaatacactaattgcttcacgaaaactagcaaaagaagaacaaaattagacaaagggaagtgtattagcttcccttttaaaaaggtattaaaattaggaggaacagaaaaagaaatgacgttaactaaagaagaaattaaattatttgagcaattaagaaaaatggagggggagtaattttaactgcccttctgcaatctacaccttgttaagatcgtttgtttttcatcacgaaattcaataagctccttaattgtacctttcaatcttatcacctcacacttaattactttaggttctttcatctgaatatcctccaataaagaatttgtataccataattaactgtaaattcattgtaacataatatatagtgaatgtatactgatggcggaaaaattttcagaaaaaaaaggaagcatttctgctccctccttagtgttacgcaccttgtttatcgttgttgtttgtttctaatctttcaatttcattaaaagcttcaattgcaatttgtagatgttcctcgcttggctgacttgttacaattaagaattgaattattccacaaaaaaaatagaatggataaaggacacaatttaaaaatttgttgtcattaacatgaatttcataagcaattcctgacgcaaggtataagattaataagaatgtatcaatatacagcttatcaagtgaattaatggcgaaacaaaagattaacatttcaagtatgatgaaattcgtcccgcaatacctgtgtattcgtgaattcattttgacattttctattgtcatatctctattttgcttgaaattatttgcaaccatatgttcagcagaatgaaatttccccatgttggttatcttagtaaaaaggattactaagatagctatagtaattaacattaagtttatttgccatactgacattggttttgaggtgtgaccttcaaaaataggagagacgataccatataaacttattaaaagaaataatattcccacttttttattcttaaatgaatcaaacaaagtaaagtaaatcccacgcaaaataggtattcttttaattaaatgagaaaataaacttaaacgataattatcgtttttttcatttagttctcgactagttattgatttaatattaaggttatttattttgcatgtggactgaaaattttcggaaatgaaagttacactattgttagtcgctcttccaccaacaagtatcaatatgccttccccctttagtttaattataccatatgcttgttgaagcttataggaaaagaaaggagaagtatgtcaaccctatttaaatgacatcgactattagatttatatatggtatcatgatgttatatattaatataaggagctttgaaataatgttactaggtgatttttacagcgaatattatatagaagtaccttgtcaagacaatcaaaagggtattgcagatgcctatatcgaacatataaaacaaggattcaacttaacagccaaagaaatatcaagttacttaaaagttagtgaactatgggttacacgacatgttgaagcgaaatatatatggttgaattcaacagctaaagccgccttaaaacgttattatcctgatagcgaatataaaaaactattcaaaaataagaaactattcaagcgttcatcatttgagttttttgtaaatcaaaacatttattatataatagaaccaaacaaggaaaagcatacgttagataaacttccttctgttctaaccacacgtaaaaggacactgacaaaatataatatcagctatcatactttctatagcaggattaatcaatcagcaattaagaagtattatatcttaggacagcctcgatacagcgagcatgatttagatcatttatttaaggataagttagagtcacttgttaaagaatttaagtagggggatggattgtgaataaggaaaatattttgaatgaatgtgtatatgatatggtggatttgattaataaactaaatttaataaatattaatgaaactaaagctgaattaaaaaaatattttttgtttttagaaagtttatcttctttaagagatacagacgatatacacttacaaagcaaacacaactctagttatgaaaacaatgcaccgaatgaaaaagttcaggtagagtgttacaaaatgaaaagaaatcttaaaggagggtggattgaagaacaggggatatatgttcccgaaagaattgttagagaatatggactagaagagggagatttaatttcggcagttcatatagcagataaacattataaatatgagcttattgagaaatcaaagaataaacagcccgtaaacagagtggagctaaattactgtattttatcaaaggagaactcttacttagtagcgtctgagtattggaaaaacggcgaaaaaagaataattaaatatgatgacattccacatactttccttatcaataacgaaacaattcagaaatatgatttaacagaaggaagtattgttgatattgcttataaaaaaagtaatgttaatgaatttaaagtgatttggaaacatgatatgaacagtattccatatgctaaaccacttccttcttctttttataaagagaaagttgataaggaagaaccactacaaacaaacgagcttaaagggaagaagattttattattgggaggacaaaggacagcagattttgaaagagctattgcaaatatcggcggagaacttacccatgcagatgatagcataaatttaaggcggcttgaaagtatggttaaaaactgtgattaccttgtaataatgatttataatgttggacatgtacgagctgaaaaagctaaagacttggctaaaaaatataacaaaccatttgatgttatggatagccgcggtattagtaacctcgtagaaaccactaaatccgttgttaattcttagccctctatttaatttgattaagataagcttttgtggtattatcttattattgtttaaaatgagtcaatgtgtcacctaatgtgtttctttaaagaggaacacatttttttattttgtctaattttcgcttcctgtacaaatataccatagaatggtattattaattcacaaggattctccttccttgtgtttttcagaaagtcaattttgggttttaaacgcttcccaaactgactttcttttttcgaaaacgccactatgcattcagtgcacattaatgttataatagaaaagagaagtagaaaagggatactcaatgcattcctttgaaagaagaatcgtcacaccattaggataatttcataattattatttttcagatataagacgatataaaaaacataaaaaagtgagagaaggtttaaaaatggaacacttactgaaagagaagaagggaattattaaaaatataatccttcgttctacagcggcacttttattaatgattcttccgtttgttttaatcaacttttttggcatttttgatcactattggattgtgtatgtctgtgtggctacacttctattttcaatacaactgactttcaatgtgttttcgttaatccaaggtttattcgacctgaaaactgccatagaatattattctcatattcattcgcaaataaaagaagcaatagatgtgtcgctagatagcgacacaattacagagatactttctggtatcataaagcactcaattaagaagtacgaacaaatgaatgatttcgacaaatattacacccttaaatctttgcgcaaacttgaagaactaaatgaaaaagaaagagatccctcatttctatttactgatgaatataagttagatactaacgaaagaattttttcgttggctctgttaggtacagcggaacaatttttatacaccttatttaacagaaaaggaatcagtttcaatgggaaacgttatttccacaatcttaatttagcatttatcgaagaagattactcaagggaaaaacaaaaggaaaaaacatgtcacactctataattgttgatgctaaaaagtttgagttgtttgacaaggtttatggacaaggaaaaaaaatatgataaacatattctgggtttatagcccgttgtcaatatcttctttaacatgttataattagtgtatgtagttgcaacacatacactttatattcactaagaaaacagggatgttcccctgttttctttttacaatcaaaagacttgacataagtaaactcctcaagcatttttccataaatataaacgaggtgaaagtcaatggatggtatagagtttttagaaaatgtgacacgacttggaataatcgttttggtgttctctggttatgctgtttattggaaattaggcaaagctaaaagggatcgagggcttacaaaatttgaagcttgtcttaggttctctgttatgtttggcataatagcatggggcgtttcgactcttgctttgagtttatggtcataatcttttttgtcgatatttgacttattctgtctaaacagcttaaaactatataaatatacccttctttggaaaaaaatgtgatactatgtagttgcttgtacaatttttcctaaagggggagttttaatgttgaaaagattggtttttctggcgttgaccctgcttctcgctattgctacaatagcgccaacagtttcagccaaggagcagaacggattagatggactgactaaagagcaaattgaaaaatcgttaaaagaagttgagtacatctttactaagattgtaatttttgatgaagagacaggttacacagttaatgaggatgagcttgaaaaatctccttataccaaaggtcaaaaagagggtatgattgccttcgctaactatatgaacaaggaatataagtatgcaagtgtccaaaaaaacactgttcaaagatgccttgaagatgctattggtatctctaaaggagcattagataaagttcaaaaggcaattgaaaaaggagattggtggacagtattagaatatttgggtaaattaggcgtagcaatctctccaccagtattatttacattcttcctgttctgcggtgctacacctgcaaagattgctccgcaagaaaattgataaacatcagttaattgggaaggggtctgaaaaagaccctttttttaattgaatctttttctagtttacataagatttattataggaagttatatagcctaataaaaaatgtctcaataactaaagtatacttaattattgagacggaaaattcataattcattatgttcgtacaaaataatgtttgatcagtcaaactctgtgctcttaattgtctattatttcccttgtggaacaacttctctaacgctaatgtttatgtctaaatatacatcacatcgctcattgcaatttgaacacaagggttgatctgtttcatttgaatgaaaatcgtttgcatttttatgtttacaaattggacattcccaatcaaataattgatttaatctgctcatttcatcaaactccattcaattgttatccactcatttattatatcaattcctaaatacacacagattatacctaatacagaatattaattgcttgtttgacaacttgtgtatttgggtcatcaagaggttgcataacttctgacagcttaatatcatctatagagctattaaagcactgtaaagcaaatcgaatcatggctttttccgaagatgaaaaaacgtctataatttcatacagcatttcaatatcaataccctctccatcaatagcctgttccactttttccgcttttaaggtagcaccagtaatataagcgaatacgccatattctaagtcctctgtaatggttgacatccctaatttctttagtaataaatttgtttgttgctcatgaaaatcacttttaaaataggtcatttagtcttctctccttctcataattcttcttgaattttttgagttctttttcatcctccgtcatccttttattttaccttaactccttattcttcctatggttttacacatactacacaaagttgtatctgtaagggaagatttccatattgaaaacttaggttcacctactgaaaaaacagcaaataatttaaggctctctctaaattcaattaaatcatttgttttaatatgggaattcgcgaacaatatatgatccgaacttccctgatttccactcatttcaatgtatagtttcttccccttttttaaaagagactctatttcttttattgttgtaggtatcatcatattcttttcacactccatatttataaatgttaaactcatttctagaattcctattattatttttgaacaagttgataatcagtttgtttaaaaaaccaacctcccatcgcccacttcaaaaattgcaaaaacatgcagttatagaaaacagcatttacagcattcgttctgttaggagaatccgcaataaaacgtgtcatattgtccaatctaaaaggaagatggattcctgtatcattcaacaaaacagatataagaataacggcaacactgaaaagataggtaacaattagtgtctttaaaggtttaaatacatttttccaatactccctaacataactggaataagctatttttctcgaatgataaaaaaagttgatgtctacaccttcttcaatacaaacacgttctgcgtgtttccaagcactccattcatcatacaaaacaaataaaccatatataggtttcagtctttttgcatcacgacattctgtaatgaactgatgaaaattcggttttctttgtatagaatcaatataatgacctaattcatgtgctaaataatgcgcttgtctatttacacttatttccggaaataaaggttcaataatatatcgtcgcagaacagtgttgtcagcaatattaatttcaggagcatatctgtataaactaggcgagtgtaaaaaactttgtttaagtatgatattctctgctttaattcgttcaattattttttctctatcattaagaaactggtgagaagggttatgttcatggttataaaaataggttttaagtctcctgtctttcttctccgtataaataagaaaagtccaccaaactatgccaatcaccaggataatttcatctaaatgaacaatactccctataacgaaactacccactgaaaaccatataagccattttggaggaaaaacaaatgtttcattccctacttttagcaaaactgttttcaaaccgaacataataaccaagagatacccaatcaatactataagcttccaatatgggaagaaccaaaaactaattaaccatactatagaagacaaaataaacaggttggtcacatgctgttgaagtttgcttgctgttcctttcgaatatatatgcagaagcacaccattcaatatgaacaaaagacttttaataatctccattagctacctccttttttacccccaaatcacaaacatccattaaagcctttgtctgtaacatagtttgtttgactccatatcaaaatttttttcttttttgcatttttttcagcaattttatattggtctaaatactttatattaggtggatatatgtatcctactcttgcaagtccttcttctaataaagacttttgaacagacttgccttccacatatacataagcgagaagcctcccatatttatctttggtttctcctttatcgaactccaattcaatttccccttggctgactaactgtttatttttcttataggcttcttttccatatggctgaacacaagagtttggtttttttgtttcaggcgtatcaattaacaaatatctaactgtttgttcttttcccttgaaattaactattattgtgtcaccatctacaaccttaatcaatttgactgtttctcgtgacgatcccttgttataaacattgtaagctaatattcccgatatagagataaataaaatcaaaaatgacaatatcttcttcatagatcaacgtccacttgacccaatataccttcaccctcagccttctcagtaaacacagcaacatttcgaattaaaccatgacatttaaaactgtatttcatgttatcactcctactcagttttcatactaatattataccataatatatatgcaatgaatagtgaatatataaaaatacacaataaaaaagatagctgatcagctatcttttcagtaaatatatatttctgagaaattatcaaaatgacccaccactatcaaaacctccaccgcctgaatcatatgaatggctatgacttcctgaatcatatgaatgagaatgtttagagtgaatatcctcagaagatacagaaatgagtgtatttatagccacatttgatggttcgctgtatgaattaatcctcgaactggaattttctttagtattatttcttctagtcatttgagagttagaaggtacttggttactttgtttttttcgtttaaataagttccacatattgttattcctccgttttgactggcatagtatagctgacataaatatgaatgccgtcttctgtttgatagactttctttttatctgcatcaggctgtatttgatcaattagaaattccgcatctcgattttttctaggattattagcaacagcaatccaaaaccaatgattccattcaacgatacaagtttttatcttttcaggtattctatgaccgattgtataaaccttaatcacttaactcccccctttggttgatagagtttctttgactactattatccataaaccaatttaccaaaaagcgcatactgcataatacaatcagcagtgtcagcatcccattggtctttatctaataagttgtgattatttatatacagagatactcccgtaattaatttttttaggtctaaagataattgattttcttcacattccaattccaattcgtacaattctatattctttccttctaaaagaagtttagccgcccacatagataacgatacgtttttaggcttttctctccaatctgatgtagagttatttaatcccatccaatatctactgtctccttcaaatgagctgacgataatattttctacgtcataatccgtgacttcaaccacaacatttacttttccgacaattttttgattagagattgacatttctattcccaccttttctttactaaatcaattatacaacattatatattgaatgtatataggaaatacattaaaagttaaagaatttcaattttgtctttatataacttgatttttaaatgagtccctatacttttttcgttaaataaacttgaaggtacagaaatatcataatttttatcatcaacatataatttaaaataataatgtgtgctttcaattcctggtgtactcgtaggcatactatacactgaaccacctattacaatcggtgttacagaaactgatgacccactggaatatgattctttagatttgtctatgattagagcatcaacttcttttccatttttcaaaacttcttctttttcttttttctctttttcttcaacttccctaacttttttttcaacattatctttataactctcaataccatgataagatatgaagggaagtgcacaaaacattaacatacctacacctacaagacctattactatccaatttgctgagttattagattccatagtttcaaccacctttatattcactgaatatatattaatttctttaaaaaaaagaggttcgaaaccatctttttttagaaataaaagacataatcactttttcatattaataatcttatcaccattatcataagaaattttctttatttcataatttattttgtggaaatatcgtttaccattgaaaccaagcattcgagaattaaacttttcataaagtaatctttctgcaaatgatttgtttacttttaataaaattaaatcatctttatctaatttggagtcttctccgagcattccttttaatggataattatctttctcttgagaaagtacctcctgcaatttaagtaacttttcatatacaaatgattgatcagttacaaaagatcgttgaatttcgttatatttttcgtatttggtaagggtatgttggataatttcttttaataatgcatcagctcttttttcacttgtatgtcctttaacatggtcataaatgtgtcgatatgatgtgattgcatgtttaaaattcgcatacgcataataaaaatagatgccttcccaaagtaatgcacccgaggtaaacagagctacgagaaaaagccctaaaagcacggggttatcgaatacttgccaaaaattacacagattgattactataaagaaagctgtcctccatataacctgaataagaaaacgttttttactatcaattaatatattcaaatagtccaagtaaatcccttctccctatcattttacttttcatttttattatcgtctttagtcaagggttttttaaagctttttcgaaaaaaccttgattggtaaagactttgttgggtattcagaattttgaccatctttaacattttcctcttgttaaaattctcaatttaataatttattagtttttctttcataggctttgatatatatatcgttatgtcttcattaaaaaaaggatataagttaaatgcaacaagttcagttagatcagactttaatgcttttttcgcaatatgtggttttgaatcggttaattttaatttcacattattcttttttattttaacctcttttaattctttagttatacacacataatagtcatccctgtcatccttacttactatacttttaatagaaacaatttcactttcatttttagtttccttatcggctgtttcatacacaaatacacctataagacaagaacaaatgcaaaggaaacccaatataactggtataaaagctaattgtctcatatcataattacaagaaattattgtcccagtagtcaccatcgcaagtgctaacattaaaagtatcaatttatctccccctaaatcaaaaattacttacaagggtcataaaattatgacccttgtacttctagtacatcatttaacgcttcctcaatatcgtcaaaaacaaaatggttctcagcttcttcatattccttcaattgatttaattctttaatatcaactggaatatagacaggagtcggagaatccttcccatcatccaaattttcggctgaaattttacttttacaaagagtgtcatgaattaaccacatagaaacgactactttcatttaaatctctcctcaccttcaatatatattcattatacattataattaatgtatagtcaatgcatattagagaataaaaaaataaagatagcataagctacctttattaaccaaagattttaaatcccgaatataacgatgtcaatttagatgacaatatagcacttcctaagatttgagacttcatataagatactacactatcaaataaatcagggaaagctattttagccgcacctacaataattgctccaataataataactccaattgtccaatataatctatctgtatttggttccattaaaatattcctcctaaaagctgtttaaaattttgggattttcatatcaaaagatttttcaataatattaaacatatcgggtaaattgtcattacataatgcaaatacaattcccaatataattacagcacccatagcaaggaacaatctacccgaattttgttccattgtcatcacctccttcaaaggactgttctatctaaccatagatattgcagaacctttcacattaatcaattgagcaggtaatgaaatgaaaaagaattcatactttccactaattgtgtaattcacttcttccccaaaagccattttacttgttccttgtgaactggctactttgaacttcccatgatagtgttccttgttatacgtgtttatcttttccattgctgttgttgtcagcccgccatttcgttcaatttggtaattgacaaactgtttaaaatcattagcttgattaatattaataaaatacgcacctaccgagaacatagaaaatataataaaaattgatatatacattttcaccatttccattgcagagccttccatctttacacctacctttcaaacagttatcttacaaactgatgctttttatggtttcaataatcgttgctaaacagtaacctccgactattaataaagttgccattgttagctttgtaggaaacataaaaaaccctcgcaacttgtagctaataatgtcgtcaacacctttaaaaagttcttggcttgaaattttacccaactcttcaattactgaagtgtcagaagtgctttgttggaagtcatacagagtagtcataaataaaatagcctgatctgtaccactagcatctattgcaaattgccggaatggttcttccgagtttggtttttcattcatccctattaagagtctttgcaatgcatctttaacatgaccatcttcaatacggtttctcattttgtttaagactttgtacactgtagcacccttttgtaacaaataagggattaacaatctggtgaatttattaaacactaattgctttttaaacctaaaatccctatattttttttgtacacttttatattcagctaaccatagaaaaacagctagtattaaccccaacacaattaataagttattaataaacaatgcggcaatgcaagacattataaaaatcagtaggcttttgaaaaatctctttttttggaatttcagaacatcctttttttcatatcccatttcgtttaacatgctgaataagtcactttcagctatttttaaccaaaatgggcgtttttcttcttgtcctatctctgttttcatatttgaacctccaaaactgagtcatcccctaatttttttataaaggaacgataaaacagactcattataatcaaatatgtggtactgaatatccatcctacaaactgatgagcgaaagtgtctacatacactgaccaaccaaaagaaaaagtgatagccaaaattaaacctaaaacaattgtacatataattttatagttgatttcctgttctctttttttagctagaaaaccatcttgtctaactttcaattcgttgtgtaaggtttttatatcctttagagtatcagtattggttctgccctcaatcatagctgttgttaattgttcaatgaacagttcaaagattacatcttctttatattctaagattaattgatcaaatgcttttttgatttcttcattatttgtaccttgtaagtttgtcaggagtctgtataaatgttcttgaaactcaccctctgaacgctctgctacagtttccaaagcgcttaacatggttcgatccgggttaattagtatttgagtcatattattaataaagttattcctttgcctgaaagattttgcttcatacactcttcggatagaaataggcattacaaccctatatccataaaaagccgctattacccccgctatagccgccacccaccaataataaaacaataagtatgtgaataaaaaagcaactgcaaaaggttttaatagggatacaagaagttcttttctttcaagagcttttccatatgctgttttataagcatttaattcatcaagagtaaactttttctttttcatgctcccactccttaaaataatccaactcataatcagagtgttgttcaattaattgatcttggtaatcatcgctgtaaggattacaaataatttcaaatcctttttttgtatatttttgtttaaaaatagtaatgtctccatcaggtctgtattcaacaacttcacttaaataacgttttacttttccattaatagtcgttttctttatatggacaccaaattgaatatatgtttttatgtcatttattaagtccttttcatccacactgtcataacccattttaaccatatgagaaaaacgttttggaatagctctcgcatttacactatgaagtgttgttacaatgttatgtcctgatagcacagcatttaataattcaaaagcttctaatcctcgtatttcagcaacacttatccatgcactgttatttctcaatcctgctttagtcaagtctaatatggacgttatttcattagttaaccaactatgaacatctttctcaggaaaaagctcttttatatgcccttcccttacatcttcaatccatacaattttttgatcaaagggaacaaaactcattaatagtttttgaaactcagtcttaccagttcccacttctcctgctataagaatgttagctctagctttgatggctgattcaaaaaaatcatacatataaaggggagcaaagttttcaaaattattttttgttaaagctaatctaggtcgagccacccgcagtgccattgttgtgccatatggtgaagataatttatgtacagcatttaagcgcaaacttttgagttgagcatccaaaataggatttttttgcgtaaactccttgtctaccacatttgcaattttttgaattacttttataatcttgtcttcactgaaatttttctcgtaaacatattttcctgaattgttcgtattgactatcaaatcagttccgttataactaatatctgtaacatcaggatcttttatgatttcctcaataactcctattccaactagttcttgcattacataattcagttgctcttcattcatccaatcattgatttcgtcttcataaattgataatgcaagtgcttctcttgcaatttcgtctgtaaaagcatctaaaaagagtttagggtcttcttttttaattttttcagcaatactttccaacacatcttctctaaccaattactctcaattccttcccgttataactttaattaactatacattgacaacacagagactgtagtatataatcaatatatattataaatagcattaattagctatatctgagactagcgtcacttgatatgtttgctttcgttcgtcagtgatctttactcgcacagccttgatgccgttatcttctctttttaaaaagctatagctatacttggggctttttaatttaacattactatttttcttgaataactcttcgaacttttgcttgaaagatttttctgtgacttctgctttgccacgctcaactctaacactcttgtcaaagctattaatacttgcacttttagcagattcagtcattgttaaaactatagctttgtgtctatattcttgtgtgaaatagtagcaacttgaaactattacaaaaaaaccaatgtatataatcattattattgaaataaaatccttcaacttgattcaccctcgctagattgcatggccaaagattatttctttagccatgctatatcttcacttgaccatcctttaggcgcaccatttgggaatgggtcatctgcatttattggtgttaacattatttcatctttgtcttttgtagttgaatccatatgaccatacatataggcatttaatttaagcgtgtcattcaatataaccttaatatcatttatacctaagttattggttcgataagacacattataatcacctaaattagcccatataggagtataaaatttacgtccgccatctattaatggttttgaaatatggctgtttttttcatcaacctgtttatcagtaaatagataacctgtttctgtttctacattgacatgaggataagaaaatgtcacattccttaaaatggaatcacctgttttagtcaatacgttttttgttttatccattggaattaaaacttcattgttcttttgatcataattcaagaagctatcaattaattcacttggtgtataatacgttaacttgctctccgaatcatcagttccaatttgattttcatattcaaagtcaatatgttgttctgttccataacctgtcttttggacaggtattttctcgccaataaacttgtactcttccctataggttttcattttcgtagtaggagttatttcagtcataaccactcctgaaaattcataacccttcaaggtatcattaatatcaaccttctttgttacttcgctacttgtgtatcctaacgttgtaagttctttatttgttttcggaacatcaaaatcgttcgcattatacccttctagtttaactgtataaggcttattttgatttacttttaaacctccagaagggattttcgcttcaaatttatcaggtaagtcttttgcagtatatgttctagttaataacttttcttcgccttgatacagggaaatattgattttagagctgtcgaatccttttgtatcaatactgtaaataagttttttagataaatataatcttactggcaaaccctttgatgcgttgtcagtgtatatttgcaatttatctaatttagcttccaacaatggaacatcataataaaaagtgattgttatatcatttttctctactgttccagtgaccttctttttcgagattggtctatacacgtaacttccttttttcaaattactcaaaggagagtatgaataggagtcccctcttctttttgtgtatatttctttttttagaagagagtgattgcgattatctttatgaagaattgttacttttctctgtaacacatagtaaaaggtgattgttatatctttactccctaaagtccctgtttttttctcttcttttacaggaacaaagacatttccgcctttttttatttctttttcggtactatagctataatttgaaccaatatcttttatttctgttttttcttttaatatagtcccctcatacttatctttgtgtataatagttatttttttttgtcttttttcaaacttgacagtaaatccatctgaaacagcagggtctaaaactattttcccccccataagtctttgaaagctcttacttggcatataaagcaggccagcatatgtgctaatggagccttttaattgtccagacttgaattcttttccgtaacttaggggtgcagtgaaatagaaagactgaccaccttttacagtaaatgatcctccctcttgggatttggaacccacatgtatagttacacctttaggaactggtatttcaactgaattctttttgtcgccattcagtttgatggtttgagatttttgaacatccccactaatagaagttgtaatctttgttttgttgaatgaaagtgcggtattgggggcatcttttttcttagcatgttctaataatgaccatacacccgaatcataattcgcgtatgaatcacttttttctctttttccttttaaccagttcactaaagctacgtgagttttaacgtagtcatccatagtatgtcctatttcattcccgtgtcctccatagccataataaagaatggctttcacgccttcatcatagtatcttttcgacgaataagattgtccaccatatggcgcaggaatatcagggtcaatacaaaacacaatctgatcatttatttttataaatgcactttcatgtgcatagcctttagggtctttccaagtataaggaccttccgccactgctgtaagtgctttagcttttgtcataaagtttggcaaagcaaacactataataatagacatgaaaacaagaatgacacctgcaaaaaaatgcttttttctttcctccacttgtaattcctccacctaaattaaggatttatatcatactcttcccaactgtttccacctttatcaatttcaccagaacctttcttgtgagaattccctttattgattgaatccacaatgctgttcacatcatccatatgactattattgtttttgttactgttatttgaactattcttcttagaaccatttgaagttttgtttgaagtgttgttattactgcttttgttagaactgtaacctccattagatgaactcctatgggacttcgaattattatagttatgatttgacgaataattattattaggactagagtttgaatatgagttagaagatgatccggaatttttgtgagaataactactgcctgagctagaattagatggtgaggaataattgttgttctgttcagtctgtttcgaactgttattagaattacgattcctctcaactgccgaactgcttgtttttatattctcagaattcacttccgttttcctgtcatcttcctttgaattcacttttgtatcattagtttcaatgttttttttcacttcttctttcttcactaatttattctttgaatctttcgccaatttcaaaagtgttttctgatcatctttatttttaatttctttaatctggttttcaagttgctcaaactctttaatactcaaactttctttttttccattcaatttattatagaccttttttatgaaagaaacttgtttgtttccttcatcaaagtctttctttaagcgagtgtaaaaagttttgttaatgtttttaattccttctaaatgagttttcgcattttttaattggttatcatgaacagtgtttattttaatttcatgttcaccattaattttcggggttttaactacaccattttcaacgaaattttcaatactattacgagccttatccattttagatacattactcaattcagtataaagctcactttttttatcttgatcttcaactttttcaatcaacgatgaaatctttttatcccaattttcttttaatcctacttttggttccttttgcttagtattgacatacaaatcatcaattgcttttcgagcatcttcataatactgtgcactctgttcagcctcagctacttttgtatgagatacataagcatatccaccccctacagccccaacaatgattgctccacccaaaagaaatgctttaaccttcatttgttttacaccctttcttcgcatgatcttgtacctatagttatttttttcatttaaattctttctttttattagtctaacacattatatattgtatgtatagtgggttaatgttgtttttttcatcaatttaaaaaatcactactataacccttgttttataaggcatttattaagttttgcaaaaaagcaaatatctatatataatatacctaatccttctaaaaaatacaaccattaattgaacaatattttaaaaatatccataaggatattgcttttcctttaggaaaatcattattgttatggataattatataatatataatggcaaataagactattgaagaaggtgactatcatcaaaaaaaatacatttttaaactcaaatgattttattcttctcctaaagaaaaatggatttgaagtgaaaaacgcccaattttcgaaattgaagtctaaaggctctctcccaccccctgacatcttattaggaaaagacaatcctagatttggttggaaagaagaaaccattaatgatttcatttcaaagcttgttagtgtgcgaaacgaattagcaaaacaaaatatttcaggggtgaataaacttggcaattggtttaatctttaatcaaatatctaaattttttgacgggattaaaatttctcttgaaaaagaatatcctattcaaaaagcagatgatctactaaatgaaattgataaagccgttctaaaaaataatgactctgttaaaatttcttatacgattgtggatgatggggaggaattaacaacagaacaaattatcttaaacggagcatattttggactcggtgattattatgaagaacttctaacaaaacaaacaacaattgatgattccaatcgttttttaaaagttttatatatatttaatactatcaaaatcccattggatgaaaatattgagaagtataaaaaactgaaagacacctttgtttcaaatttagaagataataatcatcgtacaaatcagcatgaacaatctgatttccaagcgcagttagaagaagattggctacagcatcaagaagccaagcgccaagctgagatcgaggaacagcgtaaggctgaggaagaagccaagcgccgtttttctgcatacgttatatagtatgagaaaagtaacgatatggctttttgcaaaagcaggttttatgcttgtgtaaagtggaaataatagagatagagcgatacagttgaaaaattttgcgaaacaccttatagtaagattaaagtcaaatatagtcaaagtcaataaaggagggggttgagtgggacataatatttctgacatcattgaacagtacttgaaacaagtattagatcaaaatggcaaagaaattttagagatcaaacgcagtgaaatcgctgataaatttcaatgtgttccttcccaaataaattatgtcatcaacaccagatttacaagtgaaagaggatatattgttgaaagtaaacggggaggcggcggttatattcgtattatcaaaattaaaatgaataacgaagtcgtcctcatcaataatattatttcgcagattcatacccacttgtcccaggcagcctctgatgacattattctcagactgttagaggacggagttatttcggaaagagaagctaaaatgatggtgagtgtaatggatcgttcagtgctatatattgatttgcccgaacgggatgaactaagagccagaatgatgaaagcaatgctcacatctttaaaactaaagtaagcgggtgaaaagattgatttgtcaagaatgcaatgagagaccggccacttttcactttacgaaagttgttaatggagaaaagcaagaagttcatatttgtgaacaatgtgcaaaagaaaatagcgattcatacagtataagtggaaaccaagggttctcgattcataatttattatcagggctgctgaatatggagtcctcatttcaaaacaccggttctcaaatgttcggctactcagagcaaggcacagcttgtaagaaatgcggtatgacgtttcagcagctgagaaaaacagggcgtttcggctgtgcggaatgttacgatacgttctacagccaaattacgccgatcttgcgaaaagttcacagcgggaatacggtgcatgccgggaaaattccaaaacgaataggcggaaacctgcatgtaagacggcaaatggaaatgttaaaaaaagaacttgaatctttaatacaccacgaagagtttgaaagagcagcggaggtcagggatcagatccgatcgttagagcaggaattaaaaagtacagacagtgagggggaacaagggtaatgtcgctcaagcattttattcaggacgcactaagcaattggatgaagcaaaagggacctgaaagtgacattgtactcagcagccgtatacggttggcccgaaactttgaaaatataaagtttcccgcccggtatacgaatgaagaagcctcatccatcattcagcaattcgaagatcatttttcaggtaaggaactgcctgatatcggtcaatttcatttaatcagaatgagtgaagctcagcctttggaaaaacgggtgctgatggagaaacatctgatcagcccgaatttaacggaatctccttttggcggctgtctgctttctgaaaatgaagaagtcagcattatgttaaatgaagaagatcatatcagaattcaatgcctcttccccggcttccagcttctcaatgccataaaagcggcaaaccaggttgatgactggattgaggagaaagtggattacgcctttggagagaagagagggtacttaacaagctgtcctacaaatgtagggacgggactaagggcttcagtcatgatgcatttgccgggccttgtattaactaggcaaatgaatcgaattatcccggcaattaaccaattaggcttagttgttagaggaatttacggtgaaggcagcgaagcattaggaaatatctttcaaatttcaaatcaaatcacactcggaaaatcagaacaggacattgtagatgatttaaacagtgtggctgcccagctgattgagcaggaacgttcagcccgagaagcgctttaccaaacttcgaaaattgaattggaggaccgggtattcagatcttacggcgttttatccaactgccgtatgattgaatcaaaggaaacggcgaaatgcctttctgacgttcggctggggatagaccttgggatcatcaaagggctatcaagcaatatacttaatgaactgatgattttgacacagccgggttttctccagcaatattcgggcggtgcattacggccgaacgaaagagacgcgagaagagcggcgcttatcagggaaaggctgcatttagaaatgagtgcaaatagacaggaggatgattcgatatgatgtttggaaggtttacagagcgagctcaaaaggtattggcactggcacaggaggaagcactgcgcttaggccataacaatattggaactgaacatatcttattaggtctggttcgtgaaggagaagggattgcggctaaagcactccaagcactcggactcggttcggataaaattcagaaagaagtggagagcttaatcggacggggacaggaaatgtctcaaacgattcattatacgccaagagcaaaaaaagtcattgagctcagcatggatgaagccagaaagctaggacattcttatgtgggaacagaacacatacttctcggattgatccgtgaaggagaaggcgtggcggcgagagttctgaataatctcggtgtcagcttgaataaagcgagacagcaagtgctgcagcttctgggaagcaatgagacggggtcttctgcatccggtaccaacagcaatgcaaacacgccgacgcttgacagtctggcgcgtgatttaactgcgattgcgaaggaagacagtcttgatccggttatcgggcgaagcaaagaaattcagcgtgttattgaggtattaagccgcagaacgaaaaataatcccgttcttatcggagaaccgggtgtaggtaaaactgcgattgctgaaggcctcgcacagcagatcatcaataatgaagtgccggaaattttacgtgataaacgcgtaatgacgttagacatgggtacggttgtagccggtacgaaataccgcggagaatttgaagaccgcttgaaaaaagtaatggatgaaatacgtcaggccggcaatattattttattcattgacgaactgcatacactgatcggagcggggggagcagaaggtgcgattgacgcatcgaatatcttaaaaccttcactggcccgcggagagcttcaatgcatcggtgccacaacgcttgatgaataccgtaaatatatcgaaaaagacgcggctctcgagcgccgtttccagccgattcaggtggatcagccgtcagccgatgaaagcattcaaattttaaaagggctccgtgaccgctatgaagcgcatcaccgcgtatccattaccgatgaagcgatcgaagccgcggttaaattgtccgaccgttatatttctgaccgcttccttccggataaagcgatcgatttaattgatgaagccggttcaaaagtgcgtctccgttctttcacaacgcctccaaacttaaaagagcttgagcagaaactcgatgaagttcgcaaggaaaaagacgctgccgttcagagccaggagtttgaaaaagcggcttcccttcgtgatacggagcagcgcctgagagaacaggtggaagacacgaaaaaaacctggaaagaaaaacaaggccaggagaactccgaagtttctgtagaggatatcgcgatggttgtatccagttggaccggggtgcccgtatctaaaattgcccaaacggaaacagataagcttctcaatatggaaagcattctgcattcccgcgtcatcggccaggatgaagccgttgtagccgtggcaaaggctgtcagacgtgcaagagccggactgaaggacccgaaacgtccgattggttcattcatcttcttaggccctacaggcgttgggaagacagagctggcaagagcgctggcggaatccattttcggtgatgaggaagcgatgatcagagtggatatgtccgaatacatggagaaacactcgacttcacgtcttgtcggttctcctccgggatatgtcggctatgatgaaggcggccagctgacagaaaaagtgagaagaaaaccttactctgtcgtattgcttgatgaaattgaaaaagcacaccctgatgtgtttaacattctcctgcaagtgcttgaagacggacgcttgactgattcaaaaggacgcactgtggatttccgcaacacgatcctgattatgacgtcaaacgtcggggcgagcgagctgaagcgcaacaaatatgtgggcttcaatgtccaggatgaatcacaaaaccataaagacatgaaagacaaagtcatgggagagttgaagcgtgccttcagacctgagtttatcaaccggattgacgaaattatcgtcttccactcccttgagaaaaaacatcttacagacatcgtgtcgcttatgtctgatcagttaacaaaacgtctgaaagaacaagatctctctatcgagctgacggatgctgccaaagcaaaagtagcagaagagggcgtcgatttggaatacggcgcacgtccgttaagaagagcgattcaaaagcatgtggaggaccggttatcagaagaactcctcagaggcaatattgataaaggccagcacattgttcttgatgttgaggacggcgaatttgtcgtaaaaacaactgctaaaacgaactaatatagtgacaaacatgaggcatacgtaagcgagtgtatgcctcactttgttatatagagaatattcgataaggaagaggtcttacaacatatatggctaaatcaaaaacaaaattcatctgccactcatgcggttatgaatccgcaaaatggatgggaaagtgcccgggctgcggggcttggaatacaatggtggaagaaaccataaaaaaagcgccggcgaatcggcgggcggctttctcccactccgttcaaaccgtccagaaaccatcacccattacatcaattgaaacatcagaagaaccccgcgttcaaacaaagctcgaagaattcaacagagtgcttggcggcggcgttgtgaaaggctcgttagtattgatcggcggcgatcccgggatcggaaaatcaacgctccttctccaagtatccgcacaattagcagatacggccggcagcgtgctttacatttcaggggaagaatccgtgaagcaaacgaagctgcgcgccgacagacttggcatcaacagccaaatgttacatgttttatctgaaaccgatatggagtatatttcgtctgctatacaagagatgaaacccgcatttgttgtcgtagactccattcagaccgtttaccaaagtgatatcacctcggctcccggcagtgtatcacaagtaagagagtgtacggccgaattgatgaaaatcgcgaaaacaaacggcatacctatttttatcgtcggacacgtcacaaaagaaggatcgatcgcagggccgagattgcttgagcacatggtcgataccgttctatactttgaaggagagcggcatcatacattccgtattttgcgggccgtaaaaaaccgtttcggctcaacaaatgaaatgggcatctttgaaatgcgggaagaggggcttacggaagtgctcaacccttctgaaattttcttggaagagcgttctgccggggcatcgggttcgagtatcgttgcgtcaatggaaggaacgagaccgattctggttgaaatccaggcgctcatatcaccgaccagttttggaaacccgcgccgcatggctacaggcattgaccacaacagggtatcgttaattatggctgtgcttgagaagcgggtgggtcttttgcttcaaaatcaagatgcatatttaaaagtcgccggcggggtcaaactggatgaaccggcgattgatttggcagtagccgtcagcattgcctcaagcttcagagatacaccgccgaatcccgcagattgctttatcggtgaagtgggactgacaggagaagtccgcagggtgtcaagaatcgaacagcgcgtaaaagaagcggcaaaactcggcttcaagcgcatgatcatacctgaggcgaatgcagatgggtggacaataccaaaagggattgaggttgtcggagtagcaaatgttgcagaagcgcttcgtacttcattaggaggatcataatagatggaaaaagagaaaaaaggggcgaaacaagagcttgacctgtctgcaattctgcagttcgttgcaccgggcaccccgctcagagccgggatagagaatgtacttcgggcaaatacaggcggcctgattgttgtcggatacaatgataaggtaaagcaagtcgtcgatggcggttttcatattaatacatcatttgcgcccgctcacttatacgagctggccaaaatggacggtgccattattttaagtgattccggccagaaaattctttatgcgaatacacagcttatgccggaggcgaccatttcttcttcagaaacgggaatgaggcaccgtacggcggaacgggtggcgaagcagaccggctgtctcgtcatcgccatttctgagcgcagaaatgtcattacgttatatcaggacagcatgaagtacacactaaaggacataggttttattttaacaaaggcaaatcaggccattcaaacgctcgagaagtataaaaccattttagacaaaacaattacggctctaaacgcattagagtttgaggagcttgtgacattcagtgacgtgctgtctgtcatgcatcggtatgaaatggtgctccgaataaaaaatgaaatcaatatgtatattaaagaactcggaacggaaggtcacttaatccgtctgcaggtgattgaactgattacggacatggaagaagaggcggcacttttcatcaaagactatgtcaaagaaaaaatcaaagatccgttcgtgctgttaaaagagctccaggatatgtccagctatgatctgctggatgattccattctgtttaaactgcttggatacccggcttctacgaatcttgatgattatgtgctcccgagaggctacaggctgctgaacaaaattccgcgtctgccgatgccgattgttgaaaatgtggttgaggcgttcggatttttgccaagcataacggaagccactgtagaagagcttgatgatgtcgagggtatcggcgaagtgcgcgcccaaaaaatcaaaaaaggcttaaaacgccttcaggaaaaacactatatagatagacagctttaagtatcgcttaaacctgtcggaatccgggtatattattgttagtttttgtttattctgaatttgtaggctctgacagtctgctgaaaaaatgctacttaaaaggaggtggaggtatgttaaaacgaatagttcaggcgttcttcattattgtgggcggcgttgtcggtatctttttaatacctgaattgtttgtgctgtcaaatatacaggacatacctttaataacaaacgcatatacgtctgctgcaattggtgctattatcttttttctcatcagtatatggacgacagaatatgtgattaattgggtaaaatggattgaagattctttgctgagagctccggtgccggatctgttattcgggagtctcggattggtttttggacttatcatcgcatatctcattgtaaacgtgattccgctggacaatattccgtaccgtatattcagcaccatcattccggtctttctggctttctttctcggttatctgggcttccaagtcggatttaagaaaaaggatgaactgatcagtcttttctccatttctgcaagaatgcagaagaaaaagggaagtgctgatgaggagcaggaagaacaggataaaaggctgaaaatcttggatacaagtgttattattgatgggagaattgcagatatttgtcagacgggctttttagaaggcgtcattgtcattcctcaatttgtgctggaggaattacagcatatcgctgattcttcagatgttttaaaacgtaacagaggacgccgcggactggatatcttgaatcgcattcaaaaggaactggatattacggttgaaatttatgaaggcgacttcgaagacattcaggaggttgacagcaagcttgtcaaacttgcgaagctgacatccggtgtcgttgtgacgaatgattttaatttaaataaagtatgcgagcttcaaaaggttgcggtactgaatattaatgaccttgcaaacgcggtgaagccggttgtgcttccgggcgaagagatgaatgtgcaggtgattaaggacgggaaagagcataatcaaggtgtggcttacttggatgacggcacgatgattgttgtggaagaaggccgcaattatatagggaaacatattgatgtgctcgtaaccagcgtactgcagacagcggcgggacgaatgatttttgccaagcccaagctgcttgagaaagctctttaagagggagttcatatggagtatgttgtcgttattccggctgccggacaaggaaaacggatgaaggccgggaaaaataagctgttcatcagcttaaaaggtgcgcctgttattatacacacactgcgggtttttgaaagccacgcaccctgtcagaaaataatcctggtgataaacgagagtgaacgggaagattttcgccagctgctggcccaatttccgattcagacggaaattgagctggttaccggaggtgcggagcgtcagcacagtgtatacgaaggactgaaagtgattgataaggaatcggtcgtccttgttcatgacggagcgcgcccgtttgtcacacatcagcatatcgataagctcgttgaaacagcagaggaggcgggagcggctgtcctggctgttcctgtgaaagacacgataaaacgggcggaaggctcccgggctgcggagacctttgatcgttcaagcttgtgggccgttcaaacgccgcaagcttttcgtctttctttattgaagacggcgcatatggaagcggaaaacaaaggcttcttaggtacggatgacgccagcctcgtcgagcgtcttgatggatatcaggtgagtatcgttgaaggcagctataccaatattaagctgacaacgccggatgacctgatatttgcggaagcaatcatgaaagcggaaagtgggaatcataatgtttagaatcggacaaggatttgatgtgcatcaattaacggaaggccgtccgctcatcatcggcggaattgaaattccttatgaaaagggactgctcggacattcagatgctgatgtattgctgcatacagtcgcagacgcgtgtctcggagcggcaggtgaaggagatatcggcaagcatttcccggatactgatccggaattcaaggatgcggattcttttaagctgcttcagcatgtctggaacattgtaaaagaaaaagggtacgtactcggaaatatagactgcacgattattgcgcaaaagccgaaaatggcgccgcatattgatgctatgagaaaacggatagcggaaggccttgaggcggacgtctctcaagtaaacgtaaaagcgacgacgactgaaaagctcgggtttaccggaagagccgaaggaattgccgctcaggcaaccgttctgattcaaaaagcctgatcattgttttgatgccgggtctatttggtggtagaatagatacatatattcggctagaggctacagacgagatgaaaggaagtatttgaacatgggaaatgaagtacgcgttcgttatgcaccgagtccgaccggacatttgcatatcggtaacgccagaacggcgctttttaactatttatttgcccgcagccaaggcggaaagtttattatccggattgaggatacggacaaaaagcgaaatattgaaggcggagagcaaagtcagctcaactatttgaaatggctcggcatggactgggatgaaagtgtggatgtcggcggagaatacggcccgtaccgccagtctgagcgtaacgacatttacaaagagtactatgaagagcttcttgaaaaagggcttgcttataaatgtttctgtacggaagaagaacttgaaaaagaacgtgaagagcaaatcgcccgcggggaaatgccgcgctattccggcaaacacagaaacctgactcaggaagagcaggagcagtttttagccgaaggcagacagccgagcatccgtttccgcgtgccggaagggaaaatcatcgcatttaacgatatcgtaaaaggcgagatttcttttgaatcagacggcatcggcgactttgtcatcgtcaaaaaagacggaacaccgacgtataactttgccgtcgcgattgacgattacttaatgaaaatgacgcacgtgctccgcggtgaggatcacatttcaaatacaccgaaacagatcatgattttccaggcattcggctgggatattcctgtcttcggacatatgacgcttatcgtaaacgaaagccgcaaaaaattaagtaaacgtgatgaatcaattatccagtttattgagcagtatgatgagctgggttacctgcctgaagcgctgtttaactttatcggacttctcggctggtctcccgtcggtgaagaagagcttttcacaagagaacaattcattgaaatttttgatgtaaatcgtttgtctaagtcaccggctctgtttgatatgcataaactgaaatgggtcaacaaccaatacgtcaaagcgctggatcttgatcaagtggttgagctgaccctgccgcacctgcaaaaagcaggaaaagtcggcactgagctttctgccgaagaacaggaatgggttcgtaaattaatctctctttaccatgagcaattgagctacggcgctgaaattgtcgagcttactgatttgttctttaaagatgagatcgagtataatcaagaggcaaaagccgttctggaagaagaacaggtgcctgaagtgctcagcgtatttgctgcgaagcttgaagagcttgaagaatttacgcctgagctgatcaaagcctcaatcaaagctgttcagaaagaaacaggccataaaggcaaaaagctgttcatgccgattcgtgtagcggttaccggtcagacacacggtccggagcttccgcaggccattgagctgatcggcagagaaacagccgtcagacgcctgaaaagcatttaaatatacgattgttgacagggaagagtataaaacaatgaccattacagaaagaatcttcatcggctgagagagattcatgcgtcatgttttagaagtgcgcccttaagacctttgaagaacatttctgcggaaatcagtatttaaaggcggccgccgccgttaccggcttttaagttgggaaaacattgacttgtttttcaaacagagtggaaccgcgcggtaaaagcgtctctgtcatgtttacatgcagaggcgctttttttataggcggaaaaacagactggagcggggagagaatggggggaagcatgtgttttttaaaatgctaaaagaagacatagatacagtgttcgatcaagatccggcagcaagaagctatttcgaagttgttttaacttattctggtttacatgctatatgggcgcatcggattgcacatgctttatataaacggagatttttcttcctggcgcgcctgatatcacagattgcccgtttctttaccggaattgaaatccatcccggcgcgaccatcgggagaaggtttttcattgaccacggtatgggggtcgtcataggggaaacatgtgaaatcggcaataacgtgacggtattccaaggtgtcactctcgggggaacgggaaaagaaaaggggaagcggcatccgaccataaaagatgatgctttaattgcaaccggagcgaaggtgctcggctctattacggtcgggcaggggtctaaagtaggggccggctccgttgtgcttcgtgatgttcccgacttttcgaccgttgtcggcataccggggaaagtcgtcattcagaacggaagaaaaatcaaacgcgatctcaatcaccaagacttgcccgatccggttgctgaccggtttagagcattggagcagcagatttttgaactgcaggctgaactggaagataaaaaagaaaggatcaaccaaaaatgaccattacactttataatacattgacacggaaaaaggaaacattcgttcctcttgaggaaggcaaagtaaaaatgtacgtgtgcggacctactgtatacaactatattcatatcggaaacgcccgtccggcgattgtgtatgataccgtacgcaactatttggagtataaaggatacgatgttcaatacgtatcgaatttcaccgatgttgacgacaaactgattaaggcggccaacgagctcggcgaggacgtcccgaccgtttctgaacggttcattaaagcgtattttgaagacgtgggcgccctcggatgccggaaagcggatcttcacccccgggtcatggaaaacatggacgccattattgaatttgtcagcgagctgattaaaaaaggctacgcttatgaatcagaaggcgacgtctatttcaaaacaagggccttcgaaggctacggcaagctatctcagcaatcaattgatgaactcagatcaggcgcgcgtatccgtgtcggcgagaagaaagaggatgcgctggactttgcgctttggaaagctgctaaggacggagaaatttcatgggatagcccttggggaaaaggccgcccgggctggcatattgaatgctccgcaatggtgaaaaagtatttgggtgacgaaatcgatattcacgccggcggtcaggacctgacattcccgcaccatgaaaacgaaatcgcgcaatctgaagcattaacaggcaagacattcgcaaaatactggcttcacaacggatatatcaatatcgataatgagaaaatgtcaaaatcgctcggcaactttgttttggtgcacgatatcattaagcaatatgacccgcagcttttgagatttttcatgctgtccgttcattaccgccacccgatcaactattcggaagagctgcttgagaaaacaaaaaacgcgtttaaccgcctgaagacggcatacagtaatttaaaccatcgtttgattagcagcacgaatctgactgacaatgatgaggaatggctcgctaaaatcgaagagcaccgcgcttcgtttgaagaagcaatggatgatgattttaatacggcgaatgcgatttccgtttggtttgatctggcgaagctcgccaattactacatgcaggaagacaatacggcggatcacgtcattaaagcctttatcagcatgtttgacagaatcggatctgttctcggacttacgctcggcgaagaagagcttgtcgacgaagagattgaagagttgattgacaagagaaatgaagcccgccgcaatcgcgatttcgctttgtcagaccagattcgcgatcagctgaaaagcatgaatatcattcttgaagatacagcccagggaactcgctggaagcggggagaataagcggatgcttcaatttgaacaaatcaaagattcaaagcagttaaacggtcttgcgcttgcttatatgggtgatgccatttttgaaatatacgtccggcatcacctgcttaagcagggctttacgaaaccgaatgaccttcataagaaggcgagccggattgtatcggcaaaatcacaggcagacatattgttccgccttcaggacgaatcctttttcacggaggaagaggaagccgtgctgagaagaggcagaaacgcgaaatcaggaaccacgcctaaaaacacagatgtacagacgtaccgccatagtacagcttttgaggctttactcggatacctttttcttgagaaaagagaagaaagactgaatcagctgattgctgaggctatacaagtcgggacgtcagggaggaaagcaaatgagtcagcaacatgattacgtcataggaaaaaacgctgtgattgagacgttaaagtcagatcgcaagctgtataagttatggatggcggaaaacacagtaaaaggacaggcgcagcaagttatggagcttgctaaaaagcgcggcgtcaccattcaatttgtaccgaggaaaaaactcgatcagatggtggaggggcagcatcagggtgttgtcgcccaggtggcggcatatgaatatgcacaattagacgaattatataaaagagcggaagagagaaacgaacagcctttctttctcatattggacgagctggaagaccctcataatctcggttccatcatgagaacggctgacgctgtcggtgcacacggcattgtgattccgaaacgcagagcggtcggactgacatcgacggtcgcaaaagcttcgaccggtgcgattgaacacattcccgtcgtgaaggtgaccaaccttgcccggacacttgatgaaatgaaggagcgggggatttgggtcgtcggaacggatgcatccgcccgggaagactaccgctctatggacggcaagatgcctttggcgctcgttatcggaagcgaaggcagaggaatgggccggcttgtgaaagagaaatgtgattttctcattaaacttccgatggccggaaaagtcacgtctctgaatgcgtcggtagcggccggccttctcatgtatgaagtctaccggaagcgcaatcctttaggggaatgaagacagatggacatcctgttagtagacggatacaacatgattggagcttggccgcagctaaaggatttaaaagcgaacagttttgaagaagcgagagatgtactgatccagaagatggcggaatatcagtcctacacgggaatcagagtcattgtggtgtttgacgcacatctggtaaaaggcatagagaaaaaacaaacgaatcacagagtcgaagtgatttttacacgggagaatgagacggcggatgagcggatcgagaagcttgcccaggcactgaataatattgcgacacagattcatgtcgcaacctccgattatacggagcagtgggcgattttcggacaaggggctctccgcaaatccgcccgggagcttctgagggaagtggatacgatagaacggcggattcaaaggcgggtttcaaagatcacttctgaaaaaccaccggggaaaatcgagctgtccgaagaggttttgaaaacgtttgaaaagtggcgccgaggcggtctggattaggttgacgctttttcgcccattaatgtataatatttctatctacgtgcgccggggggatcgcagtgaatctacagaacagcaagggaaagttcaacaaagtgcaattttgccagttggaggacgagcaggtcattgaaaaggttcatgttggggacagtgatgcgttagattacttgattacgaagtaccgtaattttgtacgggcgaaagcaaggtcttattttttaataggggccgacagagaagatattgtacaggaagggatgataggcttatataagtctatccgagactttagagaggacaagcttacttcatttaaagcttttgcagaattatgcattacccgccagattattaccgcaataaagacagctacccgtcagaaacacattcctttaaattcctatgtttctttagacaaacctatttttgatgaagaatctgacagaacactgcttgatgtcatttcaggcgctaaaacgttaaatcctgaagagatgattattaatcaggaagaatttgatgacatcgaaatgaaaatgggagaactgctgagcgatctggagagaaaggtgcttgttctgtacttggacggaagaagttaccaggaaatttcagatgacttaaaccgacacgtaaaatcaatcgataatgccctgcagcgcgtgaagcgcaagcttgaaaagtatttggaaataagagaaatcagtctgtagcaggtttctgtgtcatattgacagaatttttctgactgtgctattttattaagataaatgattgtttaggaaaaggtgtaacgacatgagaaaaaagattacgctggcatgcaaaacatgcggaaatcgtaattatacgacaatgaaaagctctgcatcagcggctgagcggttagaagttaagaagtactgcagcacttgcaattcacatacagctcatttagaaacaaaatagtgttcgctttttaaattgtggaggtcttttacatgcgcatgatgagtttctttaaagatgttgggaaagaaatgaaaaaggttagctggcctaaaggcaaagagttaacgcgctatacgatcacggtgatttcaacggttatcttttttgttatcttttttgccctccttgatacaggaatttctcaattaattcgtttaatagttgaataatgatcagcaatacgtgctataatagatcataatatcgtttgccaaaacccgttcagcgggttttttattgtgttgaaaaaaggattcataggctctgagcctattttttgttttacacttcatttttaaatgcggggagggaaggactgcagagtcctgatagaatggaaaagaattggtatgttgttcatacgtattccggttatgaaaacaaagtaaaagcgaaccttgaaaaacgtgtggaatcaatgggaatgcaggataaaattttccgcgttgtcgtccctgaagaagaagagactgatattaagaacggaaagaaaaaagtagtcaaaaagaaagtgttcccgggttatgtgcttgttgaaatcgtcatgactgatgattcctggtatgtggtccgcaacacgccgggcgttaccggattcgtcggatcagccggttcaggctcaaagccgactccgcttcttcctggcgaagcggaaaccatcttaaaacgcatgggcatggatgagcggaaaaccgacattgattttgaattgaatgagacagttaaagtcatagacggacctttcgccaactttacaggatcaattgaagagattgattatgataagagcaaagtgaaagtattcgttaacatgttcggccgtgaaacgccggttgagctggaatttacccagatcgacaaattgtaatgtgaaaaaacttgaaattgctatatattaatgataatatagcaaaggtacgtcttggactaatccaaggcagctagcttgatatttcgtcattcatataaagaatgaaaccttgagtgggagggtttaccctattaccacatcacggacttaaggaggtgtgtctcgtggctaaaaaagtagtaaaagttgtaaaattgcaaattcctgctggaaaagctaacccagcgccgccagttggacctgcactaggtcaagccggtgtaaatatcatgggattctgtaaggagtttaacgctcgtacagctgaccaagctggtttaatcattcctgttgaaatttcggtttacgaagaccgttcatttacatttattacaaaaactccgcctgctgcagtattgcttaaaaaagcagctggaattgagtctggttctggtgaaccaaaccgtaataaagtggcaaccgttaagcgcgataaggttcgcgaaatcgctgaaacgaaaatgcctgacttaaacgcagcagacgttgaagcggcaatgcgcatggttgaaggtactgcccgcagtatgggtatcgttatcgaggattaatttgtttcttgtcgggttgcgagttttcacaagttcgcaacccttattcgtgggaggttattccgctataaccacataaggaggaaattttaaaatggctaaaaaaggtaaaaagtacgttgaagctgcgaagcttgtagaccgtgcgaaagcttacgacgtcgctgaagcagtggcgcttactaaaaaaacaaacacagctaaattcgacgctacagttgaagttgcttttcgtttaggggttgaccctcgtaaaaacgatcagcaaatccgcggtgcagttgtacttcctaacggaactggtaaaactcagcgcgtgcttgtattcgctaaaggcgaaaaagcaaaagaagctgaagctgccggtgcagactacgtcggcgattctgattacatcgcgaaaatccagcaaggctggttcgaattcgatgtaatcgttgcgactcctgacatgatgggtgaagtcggtaaaatcggccgtgtgcttggaccaaaaggtcttatgccaaaccctaaaacaggaactgttacattcgaagtagaaaaagcaatcggcgaaatcaaagctggtaaagtagaataccgcgttgacaaagctggtaacatccatgttccgatcggaaaagtttctttcgaggatgaaaaacttgttgagaacttcacaacaatgtatgatacaatcctgaaagcaaaaccggctgcggctaaaggtgtttacgtgaaaaacgttgccgttacttctactatgggccctggtgtcaaagtagacgcttctactttcaacgtaaaataatatttgactttagatcagcattctgatatgattcaaaatgttgtaaaatataatatgtcatttataccgtagacagcaggggccgttgaggcttaatatcctgccgaggtgtatatatatcacagctattacgttacgtatgcttgtatatacagcctccatgtccacatggaggctttttatatgaaatcgtcgtcacagtcgtgatcacctagcggtataagtgttacacaaaatctacaggaggtgtaaccatgagcagcgcaattgatacaaaaaaagttgttgttgaagagattgcttctaaactgaaagaaagcaaatcaacgatcatcgttgactaccgcggacttaacgtttctgaagtaactgaactccgtaaacagcttcgcgaagctaacgtagagttcaaagtgtacaaaaacacaatgactcgccgtgcggttgaacaagctgaacttgatggtttgaatgatgtcttaactggaccgaatgcgatcgcattcagtactgaagatgttgtcgctccggcaaaagttcttaacgagttcgcgaaaaatcacgaagctctggaaatcaaagcgggcgttatcgaaggaaaagtatcttctgttgaagaagtgaaagctcttgctgaacttccttcacgcgatggcttactttctatgttgcttagcgtacttcaagctccagttcgcaaccttgcacttgcagctaaagcagttgcagaccaaaaggaagaacaaggcgcttaatctgattttaccctaaaataaaacaaatggaggaatttcaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggcgctgctgaagagcaaagcgaattcgaccttatccttgctggtgcaggttctcagaaaatcaaagttatcaaagttgttcgtgaaatcactggtcttggcttgaaagaagctaaagaacttgttgacaacactccaaaaccacttaaagaaggtattgcgaaagaagaagctgaagagcttaaagctaaacttgaagaagttggcgcttctgtagaagttaagtaatcttcacttgcctgtaggggaagctcgcttttatgaggcgggctttttctttgcttttctttaagtgcaattaaaaaaggaggttctaataatgagtgaacactattattcagaaaaaccttcagttaaaagcgataaacagacatggtcatttacactgcggaacagatcttatacattcacaagtgacagcggcgttttctcgaaaaaggaagttgatttcggttcgcgtgtcttaattgaagcgtttgaagagccggagatcgatggtgacttcctggatgcaggctgcggttacggcccgatcggtctgtcgctcgccggtgcatttacagaccggaccgtgcacatgattgacgtgaatgaaagagccgtagagctgtcaaatgaaaatgcagaaaaaaacggaataaaaaacgttcggatttatcagagtgatttattttcaaatattgattctgctcaaacatttgcttctattattacaaaccccccaatccgcgccggaaaaaaagttgtccatgccatttttgaaaaaagcgctgagcatttaagggcttcaggtgaattgtggatcgttatacagaaaaaacagggcgggccttctgccattgaaaaactgaaggagctttttgacgaagtttctgtggttcaaaaaaagaaaggctattatatcataaaagcaaaaaaagtttgacttgaattttcagctatgttaatattgtaaaatgccaatgtatatattttgcatgatatgctcaaataatcatagtgcatgtataaattatacaaacatggaaatgctaataaaatcggtatttgtttttggatgtggttttcttaattagaaacccttttttcttttgtcttgtaaaagtatttctttatcgtaagagatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctctagagttcattgactacagtttaggagatcctaagtatcccgttgaagagtcaaaagaacgtgatgtgacttactcagctccgctaagagtgaaggttcgtttaattaacaaagaaactggagaggtaaaagaccaggatgtcttcatgggtgatttccctattatgacagataccggtacttttatcatcaacggtgcagaacgtgttatcgtatctcagcttgttcggtctccaagtgtatatttcagtggtaaagtagacaaaaacggtaaaaaaggttttaccgcgactgtcattccaaaccgtggcgcatggttagaatacgaaactgatgcgaaagatgttgtgtatgtccgcattgatcgcacacgtaagttgccggttacggttcttttgcgtgctctcggcttcggttccgaccaagagattctcgatctcattggtgagaacgaatatctccgcaatacactggataaggacaacaccgaaaacagtgacaaagcgcttcttgaaatctatgagcgccttcgtcccggagagccgcctacagtagaaaacgcaaaaagcttgctggattcccgtttcttcgatccgaagcgatacgaccttgcgaatgtaggacgctataaaattaataaaaagcttcatatcaagaaccgcctgtttaaccagcgccttgcagaaacactggtggatccggaaaccggtgaaattctcgctgaaaaagggcagattcttgacagaagaacacttgataaagtattgccatacttagaaaatggaatcggcttcagaaaactttatcctaacggcggcgttgtcgaggatgaagtgatgcttcaatccattaaaatctatgctcctactgatgcagaaggagagcagacgatcaatgtgatcggcaatgcttacatcgaagaggcgattaaaaacattacgcctgctgatattatttcttctatcagctacttcttcaacctcctgcacggagtgggcgacactgatgatatcgaccatctcggaaaccgccgtctgcgttctgtaggtgagctcctgcaaaaccaattccgtatcggtttaagccggatggaacgtgtcgtacgtgaaagaatgtctattcaagacacgaatacaattacgccgcagcagctgattaacatcagacctgttattgcgtctattaaagagttcttcggaagctcacagctttctcaattcatggatcagacgaacccgcttgctgaattgacgcacaaacgccgtctgtcagctctcggaccgggcggtttgacacgtgagcgcgcaggtatggaagtacgtgacgttcactactctcactacggccgtatgtgtccgattgaaacgcctgagggcccgaacatcggtttgatcaactcattgtcatcatttgcgaaagtaaaccgctttggtttcattgagacgccataccgccgcgttgatcctgaaacaggaaaagtaacgcctagaatcgactacctgactgctgatgaagaggataactatgtcgtagcccaagcgaatgctaagctgagcgatgacggttctttcttggatgacagcatcgtagcgcgtttcagaggggaaaacaccgttgtagcccgcaaccgcgtggattacatggacgtatctcctaaacaggttgtttctgctgcgacagcatgtattccgttcttggaaaacgatgactcgaaccgcgccctcatgggagcgaacatgcagcgtcaggctgtgcctttgatgcagccggaagctccgatcgtcggaacgggtatggaatacgtatccggtaaagactccggtgcagccgttatttgtaaacaccctggtatcgtagaacgggtggaagcgaaaaacgtatgggtgcgccgctatgaagaaattgacggccaaaaagtaaaaggcaacctggataagtacagcttgctgaaatttgtccgctccaaccaaggtacgtgctacaaccagcgtccgattgtaagtgtcggcgatgaagtagtcaaaggagaaatccttgctgacggaccttcaatggagcttggtgaacttgctctcggccgcaacgtaatggtcggcttcatgacatgggacggttacaactatgaggatgccatcatcatgagtgaacgccttgtgaaagatgatgtatacacatctattcacattgaagaatatgaatcagaagcacgtgatacaaagcttgggccggaagagatcacccgcgatattccaaacgtaggggaagacgcgcttcgcaaccttgatgaccgcggaattatccgtatcggtgcggaagtcaacgacggagaccttctcgtaggtaaagtaacgcctaaaggtgtaactgagcttacggctgaagaacgccttcttcatgcgatctttggagaaaaagcgcgtgaagtccgtgatacttctctccgtgtgcctcacggcggcggcggaattatccacgacgtaaaagtcttcaaccgtgaagacggcgacgaacttcctccgggagtgaaccagcttgtacgcgtatatatcgttcagaaacgtaagatttctgaaggtgataaaatggccggacgtcacggaaataaaggggttatctcgaagattcttcctgaagaagatatgccttaccttcctgacggcacgccgatcgatatcatgcttaacccgctgggtgtaccatcacgtatgaatatcggtcaggtattagaacttcacatgggtatggctgcccgctacctcggcattcacatcgcgtcacctgtatttgacggcgcgcgtgaagaagatgtgtgggaaacacttgaagaagcaggcatgtcaagagacgctaaaacagttctttatgacggccgtacgggagaaccgttcgacaaccgtgtatcagtcggaatcatgtacatgatcaaactggctcacatggttgacgataaacttcatgcccgttctacaggtccttactcacttgttacgcagcagcctctcggcggtaaagcccaattcggcggacagcgtttcggtgagatggaggtttgggcgcttgaagcttacggcgcagcttacacgcttcaagaaatcctgactgtgaagtccgatgacgtggtcggacgtgtgaaaacatatgaagccatcgtcaaaggcgacaatgttccagagcctggtgttccggaatcattcaaagtattgatcaaagagcttcaaagcttaggtatggacgtaaaaatcctctcaggcgatgaagaagaaatagaaatgagagatctagaagacgaggaagatgcgaaacaggctgacggccttgcattatcaggtgatgaagcgccggaagaaacagcatctccagacgttgaacgtgacgcagtaacgaaagaatagtctctgattgataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttgaaacctgaaaaggacggcctgttctgcgaacgcattttcggaccgactaaggactgggaatgtcattgcggcaagtacaagcgggttcgttataaaggcgtagtttgtgaccgttgcggagttgaagtaacgcgggctaaagtccgtcgtgagagaatggggcatattgaactggctgccccggtttctcacatttggtatttcaaaggtattccgagccgtatgggtcttgtattggatatgtcaccgcgtgcgctggaagaagttatttactttgcttcttacgtcgtaactgacccggccaatacaccgctcgaaaagaaacagcttttatctgaaaaggaataccgtgcgtatctggataagtacggtaacaaattccaagcctctatgggtgcggaagccattaataaacttctgcaggacatcgaccttgtcaaagaagttgatatgttaaaagaagagctgaagacttctcaaggacagcgccgtacacgtgcgatcaaacgccttgaagtgcttgaagccttccgtaattcaggaaacaagccgtcttggatgattctcgacgtgcttccggttattccgcctgaattaagaccgatggttcagcttgacggcggacgtttcgcaacgtctgacctgaacgacctttaccgtcgtgtcatcaaccgtaataaccgtttaaaacgtctgttagacctcggcgcgccaagcatcatcgttcagaacgaaaaacgtatgcttcaggaagcagtcgacgctctgattgacaacggacgccgcggccgtccggttaccggaccgggtaaccgtccgcttaaatctctttctcacatgctgaaagggaaacaagggcgtttccgtcagaaccttctcggtaaacgtgtagactactcaggccgttccgttatcgtcgtaggcccgcatctgaaaatgtatcagtgcggtttgccgaaggaaatggcgcttgagctcttcaagcctttcgtcatgaaagagcttgttgaaaaaggccttgctcacaatatcaagagcgcaaaacgcaaaatcgaacgcgtgcagcctgaagtatgggatgtacttgaatctgtcattaaggagcatccggtcttactgaaccgtgcccctactcttcacagattaggtatccaggctttcgaaccgacgcttgttgaaggacgcgccatccgtcttcacccgttagtatgtacagcttataacgctgactttgacggtgaccaaatggcggttcacgtacctttatcagctgaggctcaagctgaggcgcgcattctgatgcttgcagcccaaaacatcttgaaccctaaagatggtaaaccggttgttacgccgtctcaggatatggtattaggaaactactacctgacgcttgaacgcgccggagcagtcggcgagggtatggttttcaaaaatacggacgaagcgcttcttgcttatcaaaacggttatgttcatcttcatacgagagtagctgttgcagcgaactcccttaagaatgtgacatttactgaagaacagcgttcaaaattgttaattacaactgtcggtaagctcgtcttcaatgaaattcttccggaatcattcccttacatgaatgaaccaacgaagagcaacattgaagagaagacacctgaccgtttcttcttagataaaggtgctgacgtaaaagctgtgattgctgagcagccgatcaacgcaccgtttaaaaaaggcattttgggtaaaatcatcgcggaaatctttaaacgattccatatcacggaaacgtctaaaatgcttgaccgcatgaaaaacctcggtttcagatattcaacgaaagccggcatcacagtaggggtttctgatatcgtcgttctcgatgataaacaggaaatccttgaagaagcacaaagcaaagtggataatgttctgaaacagttcagacgcggtttaatcaccgaagaagaacgttatgaaagagtcatttcaatttggagttcagcgaaagatgttatccaaggcaaactgatgaaatcattagacgaagtcaacccgatctacatgatgagtgattcaggagcccgtggtaacgcatctaactttacacagcttgcgggtatgcgcggtctgatggccaacccggctggacgaatcattgaattgccgattaaatcaagtttccgtgaaggtctgacagtattggagtactttatctccactcacggtgcgcgtaaaggtcttgccgataccgccctgaaaacagctgactcaggttaccttacacgccgtcttgttgatgttgcgcaggatgttatcattcgtgaaacagattgcggaacagaccgcggtattcttgcaaaaccgctcaaagaaggcacggaaatcatcgagcgtctggaagagcgtctgatcggacgtttcgccagaaaacagatcaaacatcctgaaacgggtgctgtgctcattaacgaaaatgaattgatcgatgaagataaagcgctggaaatcgttgaagccggaatcgaagaagtgtggatccgttctgcgttcacatgtaacactcctcatggtgtatgtaaacgatgctacggacgaaaccttgcaaccggaactgatgttgaagtcggcgaagcagtaggtattatcgccgctcaatctatcggtgagcctggaacacagttaacgatgcgtacgttccacacaggcggggttgccggagacgatatcacacaaggtcttccgcgtatccaagagcttttcgaagcgcgtaatccgaaaggtcaagcgacgatttctgagattgacggtacaattgccgaaatcaatgaagtccgcgacaaacagcaggagattgttgttcagggcgctgttgagacccgttcatacacggcaccttacaactcacgcctgaaagtgactgagggtgatcagattacccgcggtcaagtgctgacggaaggttcaatcgatccgaaagaacttcttaaagtcactgacctgacaacggttcaggaatatcttctgcatgaggttcagaaggtttaccgtatgcagggggttgaaatcggcgataaacacgtagaagtaatggttcgccagatgcttcgcaaagtccgtgtaatcgatgccggagatactgatgttctccctggcacattgcttgatattcaccaatttacagaagcgaacaaaaaagtgctgcttgaaggcaatcgacctgctacaggccgtcctgtccttctcggtatcacgaaagcttcactcgagacggattcattcttgtctgccgcatcattccaggaaacaacacgcgttcttacagatgctgcgattaaaggcaagcgtgatgaacttctcggcctgaaagagaatgttatcatcggtaaactggttccggccggtacaggtatgatgaattacagaaaagtaaaacctgtttcaaacgttcagccttcggaagatatggttccggctgaataacagaaactgctgcaggaaaggctgtttcgacagcttttcctcagtattacaattattctggcgggggactgcactaaaaaatgtcatacgttgttgacatccgtcccgcagagtgataatataaccaaggtgctcgaaataaaacctgttactttggaggatatgtttatgtcttatgataaagtatcacaggccaaatcaattattattggtacgaagcaaacagtgaaagctctaaaacgaggttcagtgaaggaagtcgtcgtggcaaaagacgcggattcagttcttacggctggcgttatccagcttgcaaagaaccaaaataccgctgtctgtatggtggattccatgaaaaagctcggcaaagcctgcggaattgaagtgggagcagcagctgttgccattatgttatagcgtactttttgtttttatataagatatcaatcttatgtaaagacattgttttttgcctaatgatgaaccacctgggtatgtgggttataaaacgtaatgaagggaggaacacaacatgcctacaattaatcagctaattcgcaagggacgcgtgagcaaagttgaaaactctaagtcacctgcactaaacaaaggatacaacagctttaaaaaagagcacactaacgtatcttctccacaaaaacgcggggtatgtactcgtgtcggtacaatgacaccgaaaaaaccgaactcagcacttcgtaaatatgctcgtgttcgtttgactaacggaatcgaggttactgcctacattcctggtatcggtcacaacctgcaagagcacagcgttgtactgatccgcggcggacgtgtaaaagacttaccgggggtacgctaccacatcgttcgtggcgcgcttgatactgccggagttgaaaaccgtgcgcaaggccgttctaaatacggtacgaaacgtcctaaagcaaagtaataacaataaatcattaaaactatgaagggaggatattcagatgccacgtaaaggtcctgtagcaaaaagagatgttttacctgatccgctttacaactctaagctggtatcccgcctgatcaacaaaatgatgatcgacggtaaaaaaggtaaatctcaaacaatcctatacaagtcattcgatatcattaaagaacgcactggcaatgatgcaatggaggttttcgaacaagcattgaaaaacatcatgcctgtacttgaagtaaaagcacgccgtgtaggtggagctaactaccaagtgcctgtagaagttcgtcctgaacgccgtacaactcttggtcttcgctggttggttaactatgcgcgtcttcgcggagaaaaaacaatggaagagcgcctggctaacgaaattcttgatgcagctaacaacactggtgctgccgttaagaaacgtgaagacactcacaagatggcagaagcgaacaaagcatttgctcactaccgctggtaggattcatataatcaaaataataattccctaataaggaaggagaaattacccaatggcaagagagttctccttagaaaaaactcgtaatatcgggatcatggctcacatcgatgccggtaaaacgactactacagaacggatcttgttctacacaggccgtatccacaaaattggcgaaactcacgaaggtgcttcgcaaatggactggatggagcaggaacaagaacgcggtatcacaatcacttctgcagcaacgactgcacagtggaaaggttaccgtgtaaacatcatcgatacaccgggacacgtagacttcacagttgaagttgaacgttcactccgtgtacttgatggtgcggttgccgtacttgatgctcaatcaggtgttgagcctcagacagaaacagtatggcgccaagcaacaacttacggagtaccgcgcgttgtatttgtcaacaaaatggacaaaatcggtgcagacttcctttactctgtaggcactttaagagaccgtcttcaagctaatgctcacgcaattcaattgccgatcggcgctgaagacaacttcgaaggtatcatcgacttagtagaaaacgttgcgtatttctacgaagatgaccttggaactcgttcagatgcgaaagaaatccctgaagagtacaaagagcaagctgaagagcttcgcagcagcctgattgaagctgtagctgagcttgatgaagagcttatggaaaagtaccttgaaggtgaagaaatcactatccctgaactgaaagctgctatccgtaaaggtacactgaatgttgaattctaccctgtacttgttggttctgctttcaaaaacaaaggtgttcagcttgtacttgatgctgttcttgactaccttcctgcgccaactgatgttgctgcaatcaaaggtgtacgtcctgatacagatgaagagatcgttcgtcattcttctgatgaagagccgttctctgcacttgcatttaaagttatgactgacccttatgtcggtaagctgacattcttccgcgtatattccggtacacttgattccggttcatatgtaaagaactctacaaaaggcaagcgtgagcgcgtaggacgtatccttcaaatgcacgctaacagccgtgaagagatctctactgtttacgctggagacatcgcagctgctgtaggtctaaaagatacttctactggagatactctatgtgatgaaaaggatcttgtaatccttgaatcaatggaattcccagagcctgttatcgacgtagcgattgagcctaaatcaaaagctgaccaagataaaatgggtatcgctttagcgaaacttgctgaagaagatcctacattccgtacacaaactaaccctgaaacgggtcaaacaatcatctctggtatgggtgagcttcaccttgatatcattgttgatcgtatgaagcgtgagttcaaagttgaagctaacgttggtgctcctcaagttgcgtaccgtgagacattccgtaccggtgcaaaagttgaaggtaaattcgtacgtcaatcaggcggacgcggtcagttcggtcacgtttggatcgaatttgaaccgaacgaagaaggcgctggctttgaattcgaaaacgcaatcgtcggtggtgttgttcctcgtgaatacatcccagccgtacaagcaggtcttgaagactctcttgaaaatggtgtcctagccggattcccgctaatcgacatcaaggcgaaactttttgatggatcttaccatgatgttgactcaaacgaaatggcgtttaaagtcgctgcttctatggcattgaaaaatgcagtcagcaaatgtaacccagttcttcttgaaccaatcatgaaagttgaagttgttattcctgaagaatacatgggggacatcatgggtgatgttacttctcgtcgcggacgcgtagaaggtatggaagctcgcggtaacgctcaagttgtgcgtgcgatggtacctcttgctgaaatgttcggttacgctactgcccttcgttctaacacgcaaggacgcggtacgttcacaatgttcatggatcactacgaagaagtgccgaagagcatcgctgaagaaattatcaaaaaaaataaaggcgaataattgattttgccacttaactcaagtataactactattgtaagatgaggaagtgagagcttgctttcactttctatcactctatacattactaattaaaagctcttaaggaggattttagaatggctaaagaaaaattcgaccgttccaaatcacatgccaatatcggtacaattggacacgttgaccatggtaaaacaacattaactgctgctatctcaacagtacttcataagaaatctggtaaaggtacagctatggcgtacgatcaaattgatggtgctccagaagaacgtgagcgcggtatcacaatctctactgcacacgttgagtacgaaactgacactcgtcactatgcacacgttgactgcccaggacacgctgactatgttaaaaatatgatcactggtgctgcgcaaatggacggagctatccttgtagtatctgctgctgatggcccaatgccacaaactcgtgagcacatccttctttctaaaaacgttggtgtaccatacatcgtagtattccttaacaaatgcgacatggtagacgacgaagagcttcttgagcttgttgaaatggaagttcgcgatcttcttagcgaatacgacttccctggtgatgatgtaccagttgttaaaggttctgctcttaaagctcttgaaggcgatgctgagtacgaagaaaaaattcttgaacttatggctgcagttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagaaaacagcaaaacaactgttacaggtgttgaaatgttccgtaagcttcttgactacgctgaagctggagacaacatcggtgcacttcttcgcggtgtagctcgtgaagacatccaacgtggacaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatcaatcttccagaaggcgtagaaatggttatgcctggagataacactgaaatgatcgttgaacttatctctacaatcgctatcgaagaaggaactcgtttctctattcgtgaaggcggacgtacagttggttcaggcgttgtttctacaatcactgagtaatcgactcgttcaataatgcggggtcccttatggggcctcgtttttttgtttccccgctgattccatgtataatagaacgtatacaaattttaggagcagaccgatgaacgataacttcaagaaaaccaatcgtatttcaatgcttcagcaattgcagattaatggcagtgaacaaaccattatgattaatggtgatgacaggagtagtccgctgcttttgtttttgcacggcggccccggtacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccgttcatctgaccgaacgcttatgcaagcaattcagcaggcaaaaaatatatatcgccggctattcgtggggttcagttttggcgcttcaagttcttcaagagaaacctgatttgtattatgcgtatatcggtatcagtcaggtggttaatattcaaaaggaagaaacggaagcctaccggctgatgatggaatggagcaggcaacacaaacatatcctgctgggcaagacgctgagctttatcggagcacctccatgggagaaacagctgcagcgtacgctgtttctgctttgtattgagatgaggggagggggctttacccatcatccgatcggcgctcttaaagcaggggggcgaatgctgtttggtgaaccgtacggtgtgagagggagcttcttagccgcgcggggacaaatgttcagcctgaaacacctgtgggaggatctcatgtcctttgatgcaggggaatcagtttcttctattgtaataccgtgctgttttatgtcagggagatacgatttgacggttccggggacgacgtcttatgaatattatcagaaggttgatgcgccatataaagaatggcattggtttgagaactcagcccattcgcctcacttggaggaaccggatcgctttgccgaagttgtcagccggttcgcatcgttccatctctgaaagaaaacagtcatatccttgattaatcatggtatcacctgtataataatcaaagtgtgaaaaccacaaggttctttaaataaaccttgcaacatgcgtctattttctgtataatagtgtatgttggtctttgactgcgatgaagtgagaggttgctgacacacccggccgctttgccatggcaaggtgatcaggtttttctcacggagaactgtctaacgtgatgtaggcgaaaaggagggaaaataatggcaaaacaaaaaattcgtattcgtttaaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctctcatgcgattagacttaccatctggtgtcgatatcgaaatcaaactttaattctaaaatatagaatgatcttaataggaggtgtgacgaatgaccaaaggaatcttaggaagaaaaattggtatgacgcaagtattcgcagagaacggtgatcttatcccggtaactgttattgaagcagctccaaacgttgttcttcaaaagaaaacagctgaaaatgatggctatgaagcgatccagcttggttttgacgataagcgcgaaaagctttcaaacaaaccggaaaaaggacacgttgcaaaagcggaaactgctcctaagcgcttcgttaaagaattacgcggcgtggatatggatgcgtatgaaattggtcaggaagtcaaggttgaaattttctctgcaggagaaatcgtagatgtaacaggagtatctaaaggtaaaggtttccaaggtgcaatcaagcgccacggacaatctcgcggacctatgtctcacggttcacgctaccaccgtcgtcctggttcaatgggacctgtagatcctaaccgtgtattcaaaggtaaactattacctggacgcatgggcggagatcaaatcactgtccaaaaccttgaagtcgtaaaagtagatgctgagcgcaatcttcttttgattaaaggtaacgtacctggtgcgagaaaagctttaatcactgttaaaagtgctgttaaatctaaataagtctcttaggaaaggaggaaattgatcatgccaaaagtagcattatacaaccaaaacggttctactgctggtgatatcgaattaaacgcttctgtatttggaattgagccaaatgagagcgtagtattcgacgctattcttatgcaaagagcttccttacgtcaaggatctcacaaagtaaaaaatcgttctgaagtacgcggcggaggtcgcaaaccatggcgtcaaaaaggtacaggtcgtgcccgtcaaggttcaatccgttcaccacaatggcgcggaggtggtgtcgtattcggcccaacaccacgcagctattcttacaaattacctaaaaaagttcgccgcttggcaatcaaatcagtattgtcttctaaagtgaacgacaacaacattattgttcttgaagatcttactcttgatacggttaaaacaaaagaaatggcagctgtccttaaaggattatctgttgagaaaaaagctttaatcgtaactgcggatgcaaacgaagcagtatctctttctgcacgcaacatccctggagttacagttgttcaagctaacggaatcaacgtgttagacgttgtcaaccacgagaagcttctgattacaaaagctgcggttgaaaaagtagaggaggtgcttgcataatgaaagatcctcgtgatgttcttaagcgccccgtcattactgaacgttctgctgatttaatgactgaaaagaaatatacttttgaagttgatgtaagagctaataaaacagaagtgaaagatgcagttgaaagtatctttggagtgaaagttgacaaagtcaacatcatgaactacaaagggaaatcaaaacgtgtcggccgctatactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaacggacgtcgtggcatgacaacttcagattttgctgaaatcacgactgaccagccggaaaaatccttgcttgcgccccttcacaaaaaaggcggacgtaacaaccaaggtaaattgactgtacgtcaccaaggtggcggacacaaacgccaataccgtgttatcgacttcaaacgcgataaagatggtatacctggacgcgttgctacagttgagtacgatccaaaccgttcagctaacattgcactaatcaattatgtagacggagaaaaacgttacattcttgctccaaaaggaattcaagtaggtactgaaatcatgtccggccctgaagctgacatcaaagtaggtaacgcacttccgcttatcaacatccctgttggtacagttgtgcataacattgaattaaaacctggtaaaggcggacagcttgtacgttcagctggtacatctgctcaggttcttggtaaagaaggcaaatacgttcttgtacgtcttaactctggtgaagttcgcatgatcctttctgcttgccgcgcttctatcggtcaagtaggtaacgagcagcacgaacttatcaacgttggtaaagcaggacgctctcgctggaaaggcatccgccctacagtccgcggttctgtaatgaaccctaacgatcacccgcacggtggtggtgaaggtcgcgcgccaatcggacgtaaatcaccaatgtctccttggggcaaaccgactcttggattcaagacacgtaagaaaaagaacaaatctgataaatttatcgtacgtcgtcgtaaaaataaataacggggttgtctacggttcatttcggaccgtagtgcaatcacgaagggaggttccaaaatggctcgcagcttgaaaaaaggaccatttgtcgatggacacttgatgacaaaaatcgagaaattaaatgaaacggacaagaaacaagttgtaaaaacttggtctcgccgttcaactattttcccacaatttatcggtcacactatcgcagtatatgacggacgtaaacacgtgcctgtattcatttctgaagacatggtaggccacaagttgggcgaattcgcaccgactcgtacttacaaaggccacgccagtgacgataaaaaaacaagacgctaagagaggaggcttttaaatgcaagctaaagctgttgcaagaacagtccgtattgctcctcgtaaagcacgtctagtaatggacctgattcgaggtaagcaagtaggcgaagcagtatctatcttgaacctaactccgagagctgcttctccgatcatcgaaaaagttttaaaatctgctatcgcaaatgctgagcacaactacgagatggacgctaacaatctggttatttctcaggcatttgttgacgaaggcccaacgttaaaaagattccgcccgcgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaattcattagcaaacgcctttctgacgcttctgtttctaaagtagaaatcgagcgtgcagcaaaccgcgttaacattacgatccacactgctaagcctggtatggtaatcggtaaaggcggatctgaagttgaagcacttcgtaaagcccttaacagccttactggcaagcgtgtacacattaacattcttgaaatcaaaagagcagatcttgatgctcagcttgtagctgacaacatcgctcgtcaactagaaaaccgtatttctttccgccgtgcgcagaaacaacaaatccaacgcactatgcgtgctggagcacaaggtgtgaaaacaatggtttccggccgtcttggcggagctgatatcgctcgttctgaatactacagtgaaggaactgttccattgcacactttacgtgctgacatcgactatgcaacatctgaagctgacacaacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgcggtcgcgctaaaggcggtactgaagtacattttggtgagtacggtatccaggctcttgaagcttcttggatcacgaaccgccaaatcgaagctgcacgtattgcgatgactcgttacatgaaacgtggcggtaaagtttggattaaaattttcccttcaaaaccttacactgctaaaccgcttgaggtacggatgggttccggtaaaggggctcctgaaggctgggtagctgttgtaaaaccgggcaaagttttatttgaaatttctggtgtgtctgaagaggtagctcgtgaagctcttcgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgccaacaaataatcactgaggggaggtcgtgagcatgagcgaacgtaaccaacgcaaagtttaccaaggccgtgttgtttctgacaaaatggataaaaccatcactgttgttgttgaaacatacaaaaaggatcctatttacggtaaacgcgtaaaatactcaaagaaattcaaagcacatgatgaaaataaccaagctaaaatcggagacatcgtaaagatcatggaaactcgtccattatctgcaactaagcgttttcgtctagtagaagttgtcgaagaagctgttattatctaataaagttcggaattctttttccgaagggaggtaacaaataatgattcaacaagagactcgtttaaaagttgctgacaactccggtgcgcgtgaggtacttactattaaagttcttggcggttctggacgtaaaacggctaacattggtgatgtaattgtttgcacggttaaacaagcaacaccaggaggcgttgtcaaaaaaggtgaagtcgtaagagctgttatcgttcgcacaaaaagcggagcacgcagatctgacggatcatacatcagcttcgatgagaatgcatgtgttatcatccgtgacgacaagagcccgcgtggaactcgtatcttcggaccggttgcccgtgaattacgtgaaaacaacttcatgaaaattgtttctctggctccagaagttatctaatgaaataaatgccttactcaaggaggtgcgatcaggatgcatgtgaaaaaaggcgataaagtaatggttatctctggtaaagataaaggcaaacaaggtacgatccttgctgctttccctaaaaaggaccgcgttctagttgagggcgtaaacatggtgaagaagcactctaaaccaactcaagcaaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgttgcaaaaaaatctgggcaagtcttagataaatagtatttaaaggaagggaggtctatctcatgaaccgccttaaagaaaagtacaataaagaaatttcacctgctttaatgacgaagttcaactacgactctgttatgcaggtgccaaaaatcgaaaaaatcgtaatcaacatgggtgtcggtgatgctgttcaaaacgcaaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcgggatttctaagaaatctttcgacggtcgcggaaactacactcttggtatcaaagaacagttaatcttccctgaaattgactacgataaagtaacaaaggttcgcggaatggacatcgttatcgtaacgactgctaactctgacgaagaggctcgtgagctattaactcaagtaggtatgccgttccagaaataatcaatgaaagggaggcgaaatcgtggctaaaaagtcaatgattgcgaaacaacaacgtacaccaaagtttaaagtgcaagagtacactcgctgtgaacgctgcggacgtccgcactcagtcattcgtaaatttaaactttgccgtatttgtttccgtgagcttgcatataaaggacaaattcctggcgtgaaaaaagccagctggtaatccccaagaatgggaaggaggtaattatataatggttatgacagatccaattgcagatatgctgactcgtattcgcaatgcaaacatggtacgtcatgagaagcttgaaattcctgcttctaaattgaaaagagaaattgctgacattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaaaccaggtttgcgtgtatacgctaaatcaaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacaagaatggaggtgttttagtatgtctcgtgtaggtaaaaaactgcttgagatcccttctggagttacagtaacgctgaacgaaggcaacactgtagctgtaaaaggaccaaaaggagaattaactcgtactttccatcctgatatggaaatcaaaattgaggacaacgtgcttacagttactcgtccttctgatcacaaagagcaccgtgcgctgcatggtacgactcgcagtctgcttggaaacatggttgaaggcgtatctaaaggatttgaaagaggtttggaattagtcggtgtcggttatcgtgcggctaaatccggaaacaaacttgttttaaacgttggatactctcaccctgttgagatcgttcctgaagagggcatcgaaatcgaagttccttctcaaactaaagtagttgtaaaaggtacagacaaagagcgtgtaggagctatcgctgctaacatccgcgctgtacgttctccagagccttacaaaggtaaaggaatccgctacgaaggtgaagttgttcgccgtaaagaaggtaaatctgctaagtaagaccgcttaaagtgaagaaaggagtgacctaaggatgattacgaaaactagcaaaaatgctgctcgtcaaaaaagacatgcccgtgttcgtgctaaactttcaggcacagctgaaagacctcgtctgaatgtgttccgttcaaacaaacacatttatgctcaaatcatcgatgatgtaaatggcgttacacttgctagtgcctctactctcgataaagatttgaacgtggaaagcactggtgacagcgctgctgctgctaaagtcggtgaactcgttgcgaaacgcgcttctgagaaaggtgtttctgacgtagtatttgaccgcggcggatacttataccatggacgtgtaaaagctctggccgatgcagctcgtgaagccggactgaaattttaataaaaaaaggagggacacatgattatgcgtcgtattgacccaagcaaattagagttagaagaacgcttagttacggttaaccgcgtagcgaaagttgttaaaggtggtcgtcgtttccgtttcgcagctctagtcgttgtcggtgacaaaaacggtcacgtaggtttcggtactggtaaagcacaagaagtacctgaagcaatccgcaaagctgttgaagatgcgaaaaagaatttgattgaagtaccaatggttggaactacgattccacacgaaatcatcggacgtttcggtgcaggcaatatcttgttgaaacctgcttctgaaggtactggagttatcgctggaggccctgtacgtgcggtacttgagcttgctggcgttgctgatatcctttctaagtctttaggttctaacacaccgatcaacatgatccgtgcaacacttcaaggtttaagtgagcttaaacgtgccgaagaggttgcgaagcttcgtggaaaatctgtagaagaactgttaggataaggagggaacattaatggctaaattagaaattaccctcaaacgcagtgtaatcggtcgcccggaagatcagcgcgttactgtaagaacacttggtttaaagaaaacaaaccaaactgtcgttcatgaagataacgctgcgatccgcggtatgattaataaagtatctcatctagtttctgttaaagaacaataaaaataaattataggctaaggaggtgtcctaatgaaacttcatgaattaaagccttcagaaggttcacgtaaagtacgcaatcgcgtaggtcgtggtattggttctggtaacggtaaaacagctggtaaaggtcacaaaggtcaaaacgctcgttctggcggcggtgtacgccctggattcgaggggggacaaatgcctttattccaacgtcttcctaagcgcggttttacaaacatcaaccgtaaggaatacgctattgtgaacgtagacaaattgaacggttttgcggaaggaacggaagtcactcctgaacttcttcttgagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaagacaatctccaactttatgcgtgtgagtgatattcggaataaaatcatttttacattactcatgcttatcgtctttcgcataggtgcgtttatccctgtgccatatgtaaatgctcaggcgttgcagacacaaagttcgatgggggtttttgatctccttaacacatttggcggcggtgcgctttatcagttctccatttttgcgatgggaattacgccttacatcactgcttcgatcatcattcagctgcttcagatggatgttgtgccgaagtttaccgagtggtctaagcaaggtgaagtcggccgccgtaaattagctcagttcacgagatattttacgattgtgcttggttttatccaggcattaggtatgtcttacgggtttaacaacctggcaaacggtatgctgattgaaaaatccggcatatcgacatatctgattattgctttagtactcactggaggaactgcttttttaatgtggctgggtgaacaaattacttccaatggagtaggtaacggaatttcgatcatcatcttcgcggggattgtggctagtattccgaaaactgttgggcagatttatgagactcaatttgtcggcagcagcgatcagctgtttattcatattgtgaaaatcgctttactggtgattgcgattttggccgttattgttggtgttattttcattcagcaggccgtacgcaaaatcgcgattcaatatgcaaaagggcaaggtcgttcacctgttggcggaggccagtcaactcaccttccgcttaaagtgaatccggcaggggttattccggtaatctttgcggttgcgttccttattacgccgcgtactatcgcgtcatttttcggagaaaacgatgtgacaaagtggattcaagccaactttgacaatacacatccggtgggcatgacggtttatgtcgcattaattatcgcctttacgtacttctatgcttttgtgcaggtaaaccctgaacaaatggctgataacctaaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacagattggcggaacatcattgttaattgtcgtcggggtagccttggagacaatgaagcagctggagagccagttagtgaaacgtaattaccgaggatttatgaaaaattagaggactggttttaaccattcctcttaataagagaggacgggggaaatccgaatgaacttagtcttaatgggacttcctggagccggtaaaggcacacagggagaacgaattgttgaggattatgggatacctcatatctcaacgggagatatgttccgtgctgctatgaaagaagaaacaccactcggactcgaagcaaagtcttatattgataaaggcgagctcgtaccggacgaagtcacaatcggcattgtcaaagaaagactcggcaaagatgattgtgaaagaggttttcttctggacggatttccgcgaacagtcgctcaggctgaagctcttgaaaacattcttgaggaatacggcaagccgattgattatgtcattaacattaaagtagacaaagactctttaatggaacgtttgactggacgcagaatttgcagtgtttgcggcacaacctatcatttggttttcaatccgccgaaaacgccgggtgtttgtgataaagacggaggagacctttatcaacgggcagatgataatgaggaaaccgtctcaaaacggcttgaggtcaacatgaagcagactcagcctttactcgatttttattctgagaaagggtatcttgtcaacgtcaatggccagcaggacattaacgacgtgtacaaagatgtgaaagagcttcttggaggattgagcaaatgattatctgtaagacccctcgtgagcttagcatcatgcgggaagcagggcgaatcgtggctttgactcatgaagagatgaaaaagcacattaaaccaggaatctcgacaaaagaattggatcaaattgccgaacgttttattgagaagcagggtgcaatcccatcttttaaggggtataatgggtttcgcgggagcatctgtgtatcagttaatgaagaactcgttcacggaattcccggtaaaagggttttgcgtgacggtgacattatcagcattgatatcggtgctaaattaaatggttatcatggtgactctgcttggacatatccggtaggaaacatcagtgatgatgataaacgactgctggaagtgacagaggagtctttatataaaggcttgaaggaagcaaaaccaggtgaacgtttgtcgaatatttcccacgcaatacaaacgtatgtcgaaaatgagcagttttcagttgttagggagtatgtcggacatggtgttggtcaagacttgcatgaggatccgcaaattcctcattacggtccgccaaacaaaggacctaggctgaagcctggtatggttctcgctatagaaccgatggttaacgctggcagccggtatgtgaaaacattggctgataactggacggttgtaacggtagatgggaaaaagtgtgctcattttgaacatacgattgcgattacggaaacgggttttgatatactgacaaaagtctagatgatgaaatgaattccatgacacatgtttttcattccgcacctgggcagattgtaggtttacaattggtcggaagaaaaaccggctagctgctgtcatcggaaggaagattcatcatcgtgtactaaagcagacggagaaaagcgtacatttcattctccttagaaaaagaatatcaatcattcaccctttatgattgcgtatctccggaagttcagaacagtataaacgaaacagggcgtgtgacaaacggataactgagattttctcttttgaaatttgtcagagagcaagttactgatttgaagaagggagaacacttgaatggcgaaagacgatgtaattgaagtggaaggtacgattgtcgaaacactgccaaacgcgatgttcaaagttgaactcgaaaatggccatacggttttggctcacgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgagaaatgtaaagttattcgcagaaaaggaaaagtaatggtgatctgtgaaaatccaaagcataaacaaaaacaaggataattaataaggaggtgcccagagaatggctcgtattgctggtgtagatatcccacgtgacaaacgtgttgttatttctttaacatatgtcttcggaattggccgcacaacggctcagcaagtcttgaaagaggctggtgtttctgaagatactcgtgtgcgtgatcttactgaagaagaacttggtaaaatccgtgatgttattgacaaactgaaagtagaaggtgaccttcgccgtgaagtttctcttaacatcaagcgtctgatcgaaatcggaagctaccgcggaatccgccatcgcagaggtttgcctgttcgcggacaaaactctaaaaacaatgcgcgtactcgtaaaggtccgcgtcgtactgtagctaacaagaaaaaataagtaagggaggtacctaaacaatggctgctgctcgtaaacaaaacacgcgtaaacgtcgcgtgaaaaagaatattgagtcaggaatcgctcatattcgttcaactttcaacaacacgatcgttacgatcactgatactcatggtaatgctatttcttggtcaagtgccggagctctaggattcagaggttctcgtaaatcgactccttttgctgcgcaaatggctgctgaaacagctgctaaaggttcaatcgaacacggacttaaaactcttgaagtaactgttaaaggaccaggttctggccgtgaagctgcaatccgtgctttacaagctgccggacttgaagttacagctatcagagacgtaactcctgttcctcataatggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccgcttgagcgtggatatggtacaactctgggtaactccttacgtcgtatcctcttatcctcactccctggtgccgctgtaacatcgatccagatagatggtgtactgcacgaattctcgacaatcgaaggcgttgtggaagatgttacaacgataatcttgcacattaaaaagcttgcattgaaaatctactctgatgaagagaagacgcttgaaattgatgtacagggcgaaggaactgtcacagcagctgatattacacacgacagcgatgttgaaatccttaatccggatcttcatatcgcgactcttggtgagaatgcgagtttccgagttcgccttactgcacaaagaggacgtgggtatacacctgctgattcgaacaaaagagacgatcagccaatcggcgtgattccgatcgattcaatctttacgccagtttctcgtttatcttatcaggtagaaaacactcgtgtaggccaggttgcaaactatgacaaacttacacttgatgtttggactgacggaagcactggaccgaaggaagcaattgctctcggttcaaagattttaactgaacaccttaatatattcgtcggtttaactgacgaagctcagcatgctgaaatcatggttgaaaaagaagaggatcaaaaagaaaaagttcttgaaatgacgattgaggaacttgatctttctgtccgttcttacaactgcttgaagcgtgcgggcattaacacggttcaagaacttgcgaacaagacggaagaagatatgatgaaagttcgcaacctgggacgcaaatcacttgaagaagtgaaagcgaaacttgaagaacttggactcggccttcgcaaagacgattgatctagtttccatgtgaactaggattttcgtgtgttttttaattagaaacagcattccattaaaggaggggacatcacatgtcatacagaaaactaggacgtacgagttcacagcgtaaagctatgcttcgtgatcttacaacagatttgatcatcaacgaaagaattgaaacaactgaaacacgtgcgaaagaacttcgctctgttgttgaaaagatgatcactcttggtaagcgcggtgacttgcatgctcgtcgtcaagctgctgcatacattcgcaacgaggttgctaatgaagaaaataaccaagatgcacttcaaaaattattctctgacattgcaactcgttacgaggagcgccaaggcggatacacacgtattatgaagcttggtcctcgccgtggtgacggtgcaccaatggcaatcatcgaattggtttaatcacatatttttgtgtatctaaagaagggcgggacagtttctaactggatctatgccctttttttagatatcagaactttttatcatgagacagaaaagcagagctatagctgagaggaggtcaggcgcccgtggatcaaaaacagcttatatccgtaaaagacattctattccgctaccgcaaagatgcagaaagaccggcgctggacggtgtgagtctggaggtatatgaaggagaatggcttgctatcgtaggtcacaacggttcagggaagtcgactttggccagagcgctgaacgggctgattttgcctgaggccggagaaattgaagtcggcggcatcaagctgactgaggataccgtgtgggatgtgcgaaaaaaaatagggatggtctttcagaatcccgataaccaatttgtcggaacgactgttcgcgatgatgtggcttttggtttagaaaacaatggtgttccgcgcgaagaaatgattgagagagtagattgggctgtcacacaagtcaatatgcaggattttcttgatcaagagccgcaccatctctccggaggtcaaaaacaaagagtggcgatcgcgggaattattgccgcgcgtcctgatattatgattttggatgaagcgacatccatgcttgacccgattgggagagaagaagtccttgatactgtcagacgcttaaaagatcagggcatggccaccgtcatttcgataacacatgacctggaagaagccgcaagggcggacaggatcattgtgatgaacggcggcaggaaatatgcagagggcacgcctgaagagatttttaaattaaatgaagacttggttcgcatcggtcttgatttgcctttctcattccagctcagcctgcttttgaaagaaagcggactggcgttaacgaaaaaccatctgactcaggaagggctggtgaatgagctgtggacattaaaatcaaagatgtagaacaccgctatcaaatgaagacaccgtttgaacggcttgctctgtatgatatcaatgccgtgataaaagagggcagctacgttgccgtcatcggacatacagggtcgggcaaatcgacgctcctgcagcatttaaacggtttgctgaaaccgactaaaggacagcttgagctcgggagcacgattctggcagccggtaaaaagaataaagaccttaagcctctgcgaaaaaaagtcggaatcgttttccaatttcccgaacatcagctgtttgaagagactgtgctgaaggacatcgcattcggaccgatgaatttcggtgtaaaaaaagaagacgctgaacggaaagcaaaagaaatgctggggcttgtgggccttccggaagacattttggatcgttcaccgtttgagctcagcggcggccagatgcgcagagtggcgattgccggcgttctcgcgatggagccggaagtgctggttttggatgaaccgacagccggtcttgatccgagagggcgccaggacattatggacatgttctatgcgcttcatcagcggggaaacctgactaccgttctcgtcacccacagcatggaggacgccgcccgctatgctgacgaaatgatcgtcatgcacaaaggcaccattaaagcgacggggagtccgcgtgacttgtttgtaaaaggtgaagagatggccgaaatgggactggatcttcctgagtcggtgaagtttcagagacggcttgaggaggctctcggagttaagtatgaaaaacccatgctgaccctgcaggatgccgcgagcgaaattaaggctttctttcaggaggaaaaggaccaatgatggacagcatgattatcggaaagtatgttcccggatcatcgcttattcaccgattggacccgcgaacaaaacttgtcagcatctttctttttgtatgtatcgtttttttggcaaacaacgtacaaacgtacgctttgctcggtttgtttacattcggggtgatcgccttaacacgagtgccgttcagctttttgctgaaggggcttaagccgattatctggattgtggcgtttacctttttattacacattttcatgacgcatgaaggatctgtcatttttcagcttggctggtttaaagtgtatgagggcggacttatacaggggatttttatctccctccgtttcgtttaccttatctttatgacaacgctgctgacgctgacaacaacgccgattgaaataacggatggaatggagcagctcttgaatccttttaaaaaggtgaagctgcccgtacacgaactcgcattgatgatgtcgatatcattgcgatttatcccgacattgatggaagagacagataaaatcatgaaggcgcaaatggcgaggggtgctgactttacaagcggcccggtgaaagacagaatcaaagcggttgttccgctgcttgtcccgctgtttgtcagcgcctttaaacgcgcggaagagcttgcggtcgccatggaggcgagaggctaccagggcggtgaggggagaacgaaatacagaaagctcgtctggaccggaaaggataccggagccattctgctcatcatcgtattagccgtgttattgtttttcttaagaagttagaggtgctgctgaatgagagtgaaatgtaccattgcttatgacgggcatttatttaacggatatcaggttcagcctggaaagcggaccgttcaaagtgaattggaaaaagcgctggccgtcatccataaaacggacggcagggtgcctgtcatctcatccggccgcacggacagcgatgttcatgctgccgggcaggttattcattttgatacgccgctgtccatcccggctgagaaatggccgtttgcgctcaatgccctgctgcctgatgatattgccgtcaaaacagcagagattgcggatgatgggttccatgcacgatttagcgcagtccaaaaggaatatcgctactttgtatatacggagaaacacccggacgtatttaaacgacattacgcttaccattttgcatatcagcttaatgtgcagaaaatgagggaagcttcaaggcacctcatcgggacacatgatttcacaagcttttgcgcggctgataccgcggttcaggataaggtcagaacgatttacgagctggattggactgagaccggagacggcctgcagatgcggatcaccggaaacggttttctctataatatggtcagaatcattgccggaacgttattggatacaggagctggaaaattttctcccgatgatgtaaaagcaatgctcgaagcgaaggatcgcgaagccgcggggcgcaccgcaccggggcacgggctgtatttatggagcgtttgctatgacaactaaaccaggtgtaacattttcttgacagagtctgcataaagttataagatatcatatggtatgtatttcaaccccacgataagccccggaacttattgtgttgtgaaatagaacgtaacagaagtttatgaaaaaatgacagatcatttaggagggaattaaatgcgtacaacacctatggctaacgcaagtactattgaacgcaagtggttagttgttgatgcagcaggcaagactttaggacgtctttctacagaagttgcatctatccttcgcgggaaacacaaaccgacttacacaccgcacgttgatactggagatcatgtgatcatcatcaacgctgaaaaaatcgagttaactggtaaaaagttaactgataaaatctactaccgtcacacaatgcacccaggcggtctgaaatcaagaacagctcttgaaatgcgtacaaactaccctgagaaaatgcttgagcttgctatcaaaggcatgcttccaaaaggttctctaggtcgtcaaatgttcaagaaattgaacgtataccgtggttctgagcatccacatgaagcacaaaaacctgaagtttacgaacttcgcggttaattaaaaaggaggttaccaatttggcacaggttcaatattacggtactggccgtcgtaaaagttctgtagcgcgtgtgcgcttagttccaggagaaggtcgtatcgtcgttaataatcgtgaaatcagcgagcacattccatctccggctctaatcgaagatatcaaacaaccattaactttaactgaaacagctggtacttatgatgttttagtaaacgtacatggaggcggcttatctggtcaagctggagcaatccgtcacggtatcgctcgtgctttgcttgaagcagatccagaataccgcgcaacacttaaacgtgctggtcttctgactcgtgacgcccgtatgaaagaacgtaaaaaatacggtcttaaaggcgctcgtcgtgcacctcagttctcaaaacgttaatcgttttggatggcaaaaaccacaacttcttggttgtggtttttttgtatttttttctcatatcgaagaggttatccgatgtttttctagaattgtttgttatactctattcattaccaataaggagcgcagttataatgaataagttagtcatacataacagcaaggcatgggataaaaaagtcgaaacaggcaatgaatggacggttgcggttgattctcatacaattggtgaagcgaaaaaaggcaattggagcatcagaatgacccccggaaaagatgtgccggcggattggtttccgcccatagacggtctggaggttctttgtctcgcttcaggaggaggacagcaagggccggtccttgctgctgcaggagcggacgtcaccatctttgacaattcggaaaaacagcttgcgcaagacagaatggtagctgagcgggacggtcttacgcttcggactgtcaaaggcagcatgaatgatctgagctgttttgatgatgagtcatttgattttatcgtgcacccggtatcgaattgctttgttgatacggttcttccggtatggaaagaagctcatcgcgtattgaaaaaaggcgggtctttagtctccggttttgtaaatcccgtcgtgttcttatttgatatggatttagagcaggaaggcgtactaaaagtaaagtattccattccgttttcggatgaaaaagatctgagtaagaaaaaggtaaaggaacttattgataatcatgaagcgcttgaattcggccatacgctggaggatcaaattaaaggtcagattgacgcaggctttatggttgccggtttttacgaggacaaaggcggcctcgtgctggatgaatacattaatacatactccgtaacaagaagcattaaaatataaaaacggcatcccgtcagaggtgctgtttttttgcggctttttcctgcggacggctgatcacattagccgaaaccggttctattccaatctctctggcccaaaccgacagttgtcccatgtggtgaatctcatgcgcaaggatgtggcggagaatatcttctttaggaaaggtttggtccatccagtccggcttaacaagatccgcccctttgcgggagaccgcatgaatgacatcctcccgatactgttcagacagctttctgagatcctgaatgctcgtatagtcagactcagcgggtaaaacatcatctttacctaaaatggcacgagcccagctgatctcgacatcaatgatatgaaataaagtccgcaagatgctctccattccgcccgtccgggttttcgtcagttcctcccggctcagcttttcacatatcataaaccactcgtcacgcaccgtccaattgtattgaaacagctttttcatcacgtcacctcagctctttattcttccagttaacatgaaactccttcatttgggaggatttccactatcaacaaagcatgctttttcccttttcctttcaaaataacagtaaaaaggagcgtggctggcaatggcagaagtattatctttttcagacgtgaaacggcagaaggattatgagcttgagaagagtttactaaaggagctgtcactgacgcagatcattcagtccgtaaaagcatgtctcacccctttgtttccctttcttcaagacgaaaacggcattctgagtgaaggatgcatagattttgcaattgaagcgtatttattaggcggccggttcggcgtctttggctattatggtgagtctttgcagagggcaaacgcacgttcggctgaagaagaggaagaactgacggccgatttttttgaatatctttgcaattggacgcatgagcaatattcttccgttgaacaaaaagaaatctatgaagcgtcctgccggtttatcaacagctggtggacggaaggatttctgcaaagagaaaaacaatgtaagctccgcatgaggtaatcataatttcttcccttgtcccatacttattaataacggggacaagcgggagggaaagctatgacaaaaaagctgaaatggctcggttttttacttggctttatcatattattgtgtttattccgatttcaattccataatgatgattcctggcggccgtggagcctgccgctgagcgggaaaatcatctatctcgatccgggacacggcgggccggacggaggcgccacgggaggcagtcaccttgaaaaggacattactctcgaagtggcctccagggtcagagactatttgcaggagcagggagctttggtcattatgacgcgggagacggatactgatttagctcctgaagggacgaaaggctacagcagacgcaaagcggaagatctgagaaagcgcgtggagatcatcaaccgttcagaggcggagctttatatcagcattcatctgaacgccataccgtcaccgagatggagcggcgcccaaagcttctactatggaaaatacgaagagaatgaaaaagtggcaaaatatatacaggacgaattgagaatcaatttggagaatacaacgagaaaggcgaaacggatacacggcatttacttaatgcagaatgtaaccaaaccgggcgccctggtggaaatcggatttctgtccaatcccgcggaagcgaaaaggcttggccagcctaaatatcaggacaaaatcgcttcttccgtgtataagggcgtgttgagatattttacagaaaaaggagaccctcccgagtaaggagggtttttcgccgattctacgtttaaaatatatgttataataccatttgtaaacgaatacacaaagggtgagggttcgatgataagagaagatgaagtaagaaatatagtcggaaacatgcgcgaaccttttcttcatagaccgctgggagaattggatgccattaaagaagtaaaggtcaagccggaaaaacggcatgtcagtgtaaaaattgcattggcaaaaacggggacggctgaacagatgggcattcagcaggaaatcgtatccgttctgaaagaagcgggtgcggaaactgtgggactgcggtttgaagagctgccggaagaaacattggcgaaattcagccggcctgctgctgaaagcgaaaccctgctgaataggaaacatccgccggtctttcttgcggtggcaagcggaaaaggcggtgtcggcaaatcaacggtttccgtcaacctggccatttctcttgcgcggctcggcaaaaaagtcggcttgatcgacgcggatatatacggattcagcgtgccggacatgatgggtattacagttcgcccgacagttgaaggagaaaaactgcttcctgtcgaaagatttggagtaaaggttatgtcgatgggctttttcgtcgaagaaaacgctccggttgtgtggagagggccgatgctgggcaagatgctgaataacttcttccatgaggttgactggggagaggttgactatatcgttctcgacctgccgcccggcacgggtgatgtggcgctcgatgtacacacgatgcttccgagctgcaaagagattatcgtatcaacgccgcaccctacagccgcatttgtagcggcgagagcgggatctatggcgattaagaccgatcatgaagttgtaggggtcattgaaaatatggcttactatgaaagtgcaaaaaccggcgagagagaatatgtgttcggtcaaggcgggggagataagcttgcagaggaattgcaggtgccgctgcttggcagaattcctttaaaacagcctgattgggacaaggaccagtttgcgccttctgtctatgacagaagtcatccgatcggggaaatttatatgggtatcgcccaaaaagtcattgaaaaaacagctgaataaaaaaggggccgggatcaacacggcccggccttttattggctttctttttcagaacttgaagccgcttttttcaattcatcctcgaattgctttttgaaaagcgggctggaaagtgtctctgtaattacatcttctaagtaactgcggaacttttggcttttcaccagctcatagtattttttatccatgccggggtcctgcatgatctgcataaaacttttctgataatcagggtctttcatcagtttttttatgattttttcgtgctcgggctgaagcgtttttgcaaagctctccgcgaactttgagtcttcaaagatggttttccagaactccgccccttttttagaggtgagggttttctctattgtgcctttaatggcattttgatcaatcaccaatgcctcattcatcgcatcatcatttaatatttccttaattgctttttttccatcatctgtctttaatatatcaacaaccatttttttagtctggtcataatccatatccgctgcttggtcttttggagcacaagctgttacagataatacaataaaacagcttatcaatagcgttttggcttttgacatgcataagctccttccttacttgtacttatttttaatatgattcatcggaatggatttatacataacaaaatatcgctgaacgcgattgtcagggggatgaataagagatgaaaagccgcgggcttgttcgatttttcttttcgattttagctgtgggcgctcttattacaagcgtcgtgggatttgcactgaagtggggggagtacaaggggttctttctgaattttgaggccggtcagattttctccgttctgatctggtttatcggggtaggcatgattttcagtgtgatcagccagatgggattcttcgtctttctgacggtgcaccggtttgcccttgaaattctcagatcaaactcgctttggaatctgcttcagctgtttatcattctgtttgtcgcttttgatttaatgtacgtcagatttttgtttttcggtgagcgggatgactcgattgcggggtttgtctggctgccgctggctctgcttgccgtcggcctgttgacggcgtatataaaacaaaagcagtcctcaaaaaatacgttcgtttcatcattatttttaatggtcgttattacagcgcttgaatgggttcctgcgctaagagtgaataatgaggactggctttatttgatgctgattccgctgatgggctgcaatgcgtttcagctgttaatgctgccgaagtttgcccagaggtagttatttcacttctgatgacttgacgtcagtatttgcgatcaggtcgccgactgtcacgtttttcagtcctttttgctttaaattgtgaatgatggcggggagcgcttcttcggtctgtgttgctgaatcagaggcgtgcagcaggacaatgtcgccgccttttatatgactgtttacattttcaatgattttatcaggaccgggatttgtccaatcctgcgagttaacgctgtaatgaaccactgaatagcggtactgctgtgcaatggcaagaacctttttattaaattgtccggtcggcgggcggagtaaatgaacattcttcacacccagctttttaaatgcggtctgggcccgaaggatatctttttttatttcgttgtcctctaggttggtataattcttatacgcatatcccatgctgccgatttgatgtccgtcttttaccatacgttcaactgtgtccgggtgtcgttccgcccaagaagctgacagaaaaaaagtggcgtttttaataccgtttgcttttagcgcgttcagaatcggaaccgctttttcgtcgccccagctgatatcgaatgttaatgcgacttcgcccgctttcgtctccccttttgaaatagccttcgggccgctatcagttaaaaatacaggaagggggacggctctctgtatataaaaaaagctggctgctgcaaatgcggcaataataataataagcagctgttttatccttctgatgtgccacacgtagaagtggttcactggtgacgcctccttatcttgtccatgcttgattacatcgtatgccgcggcggagatgaatataacgaaatacgtttcaaaaaaaaacgaaaaaaatacttgctaaattcagcggatgcatatatttacggtaaaggcagctcatcatgagctgccttttttgtttttgaataaaaacgaaacaaacaccgaaatacgggaacgcccatatactaattgcaaacttcaaaaagatccaaattgtgtatacaatcaacagtttaagggaaggctattcatacggaggtgggcaaaatgaatgaaacgtccggccatgaagaaacatgtattgtgtgtgaaaccaagaaaagcaggggaatccatatttatacgaaatttatatgtttagagtgtgagaagaaagtagtttccactccgacctctgatccgaattatgaatttttcgttcgtaaattgaaaagccttcatacaccgacgttatattcttaaccctgaaaagggtcttttttttgcctgaaatcagaggagttttttcactttttataaaagaactgatacgataagaagaggaacttgtttagacatggaatgtaatagataatactgataaaagtgaataaataggagtcgatcaagtatgaaaccgtttattcaatatatgaaatggacattttgcgggagcacagtttttgtattagcggggataaccttctttacgatagggcatcagccttttctgtattcgcttttatacggggcagccggcggagccgcagtcagtgcgtccggcttgtggaatgcgaagcgtctctttttaaaaaaacaccggctgacaagaaaagaatatgcttatatcaaggaaaatctcgaggaagcaaagggtaaaatcatccgattacgcagggcgcttttccgctcgaaaagtatacaaatgctgaagcagaatgcagagatactgcggataacccgacgaatatatctgctcacaaagcaggagccgaagcgtttttatcaggcagagcgtttctattatcaaacgcttgattctgttgtggaactgacggaaaagtatgctttgctctcatcacagccgcgaaaaaataaagatttatcaatgtccttgagtgagacgaggatgactctggcggatctttccagaaggctggaagaggatcttcatgaactgatgaaggaggacatcgacgacctgcactttgaattagatatggcaaagcattcactgagaaaataagaaaggaagaaggaaatggccaaagaccgttccgatgacagcataggcgcccaaaatgaccagactcatctaaagcttgcagatacgctgccggaagaaaaaagagaagcggcacttcagctcgctgaaaaactggaccctgggaacatgcaaagcattgttctgtttggttcacaggcgcaggcgaatcttctggaattttcccacacgatgatagagcacgtgcaaagaaaagatgcaggagagatgggacaaatattggctgatctgatgctgaagcttgaccaggtaaaccccgatgatctgcaggtaaagaacaaagggtttttcgcccggctgtttaaaagggtatccggatctgtgcaggaagtgctttcgaaatatcaaaagacaagtgtgcagattgaccgtatcagcagaaggctggaacattctaaaaatgtgctgttgagtgacaataaatggttagatcagctgtacgcccaaaataaacaatacttttctgatttaactatgtatatagcagcgggtgaattaaaattagatgagctgaaaacaaagcttattcccgaagctgcaagaaaagccgaattacgagaacacaatcaaatggccgcacaggaagtgaatgatcttcgccagtttgccgaccgtctggataagagggtgcatgatctgctgctgagcaggcagattacgcttcagagtgcgccgcaaatccgtctgattcaaaacacgaatcaggcactggcagagaaaattcagtcctccattgttacggctattcctttatggaagaatcaagtcgccatcgcgctgacgcttatgaggcagcggagtgcggcagatgtgcagcagaaggcggcggatacgacaaatcaattgctgctgaaaaacgccgaacttctgaaaacaagcacagtcgagacggccaaagccaatgagcgcggacttgttgaggcagacaccctcaaaaaagtgcaggaaagcttagtcagcacacttgaagaaatcatgtctattcaagaagaaggcaggatgaaacgcaggcgtgccgaggaggagcttgttatcatggagggcgatttaaaaaagaaactgcttgatatgaagtccggccgggataacggctagatggcaaaaagtcttaactttaagttggctcgcaggcacgatataataagaaagacaggcaaaggatttgtttaaaaatggacacacctttatatacagcgctgatgaagcatgcgcaccgaaatacgtattcttttcatgttccgggacatcacaatggagatgtcttttttgatgaagcgaaatctgtatatcaatctcttttatctattgatatgactgagatcacgggtcttgatgacttgcatcacccgacaggggtcattaaggaagcgcaggatttggtgagcagattgtacggctctcaggaaagcttctttctcgtcaacggaacgaccgccggcaatctggcgatgattttagctgtttgtgaaccgggtgaacccattctgatccagcgtaattgtcacaagtctgttttccatgcggtgacattggccggagccaagccggtttatttggcgccggaaatcgatgaaaacatgcatgtgccggcacatgtatccctttcagtcatcgaaaaagcgctggcgtcatatccgaacgcgaaaggacttgttttgaccaatccgacttattacggacacgccgccgatttgactgcggcagttaaaaaagcccattcatacggtgttcctgtgctggtggatgaggctcatggagctcactttgtgttagggcagcctttcccgccttcatcattggctatgggggcggacgccgttgttcaatcggctcacaaaacgcttccggctatgacgatgggatcttactttcatttaaacagcacccgaattgacagagatcgattaacttattatgtaagcagtttgcaaagcagcagcccgtcatacccgattatggcatctttagatacggcgcgtgcttatgtgcaggatattgctgaaaaagggacacttcccgtccatatggagcacattgagaaaatcaaacgaaggttcgcatcaatttcttctattgaaataatcgagccttccggatatgggctgcgggcggacccgttaaaattaatacttcggtcaaagctcggacattccggctattcattacaacgcattttggagagtgagggcattgttgccgagctggctgacgagtaccaagtattgctcgtactgtcgataggcggccggcggatgatagaacaggcagccgtaagaaacatacagcagaaactggagaatacaccgcccgataaattgccggatgccgtgaattggacatttccgtccatttcgacacttgaatatccgcaaaatgagatgcggaagtttacaaaagagcctgcagatataaataaggcggccgggcgcttgcatgcggggaacattattccttatccgccgggaattccgctgatcatggacggcgaacggataacagaagagatcgtacagaagctttcccgtttaatcggcatggacgcgcatattcaaggcttgttaaacggggaacaattacttgtctatatagaagaggagaaatcatgagcggtttatttataacatttgaaggtcctgaaggtgcagggaaaacgactgtgcttcaggaactgaaagagattctgtcggcagaggggctcccggtgacagcgacaagagaaccgggcggcatcgacattgcggaacagatcagagaagtgatcttaaataaaaacaatacactgatggatgcaaaaacggaggcgctgctttacgccgcggcgagaagacagcatttaaccgaaaaggtgcagcctgcattgaaagaagggcgcattgtgctgtgtgatcgtttcatcgacagttcgctggcttatcaaggctatgcgagagggctcggcattgatgaagttctttctatcaaccagtttgcaatcggcgatacgatgcctgatgtcaccatctatttttctattgagcctgaagaagggttgaaacggattacgtcgaatgattcaagagaaaagaatcgtctcgatcttgaggccctgcactttcacacgaaagtacgggaaggataccaaaaggttatgcagcgttttccggaaagattccatacaatcgacgcatcgaaaaagaaggaactcgtcattcaggacgcacttcaagtgataaatgaagcattgaaaaaaattcagttgtgacctgtttctcataagttgctataatgaatgtaacgacaatgttctttccaacctaaagggggcctagagaatgaaattaatagtggcagtggtgcaggatcaggacagcaacaggcttttgaaagtattaaccgaccacaacttcagggtgacgaagcttgcgacaacaggcggattccttaaatcaggcaatacgacgtttatgatcggggtggaagatatccgtgtcgataaagcgctcagcctcattaaagagaatggctgtaaacgtgatcagatgattgccccggtatccccgatgggcgggaatgcggattcctacgttccatatcccgtcgaagtggaagtcggcggagcgacggtctttgtcctcccggtcgatgaatttcatcaattttaaggatttgacgacgtgaaaataaattctgacttacgtacatttattgagaaaaagcagcagcctgcttataaagcggcagagctttccggaacgtttaaaagttcaatggacagccaaagcagcaagctgaaatttgatcagctgagcaggttcttaacggatatagaaacgttcgggaaaaggctgacgaagtcgagaaacttcaaagacttagcgaagttcaaaggattggtaaaacgttttgtaaaagaggccgtagacagcggattatcgcatgagacggagaaaagctttgacttgtacggcagcagccggaccctggggcttgtgaaagaaatagatgaaaaactgcttcagctgacggaagaaatgttagatcaggaaaaaccggcaattgatttgctggatcgaatcggagaaataaaaggtttattgattaacctttacacatagagagtgatacaatggcaatatcatggaaggaaatgaccgggcagcagcccagagtgatgcggcttttgcataacagcattgaaaagaaaaggctttctcacgcatatctgtttgaaggcaaaaaaggtacgggcaaattggatgccgcactgcttctcgcaaaaagctttttttgccttgaagacgggactgagccttgcggagagtgccggaactgtaagcgtatcgaatccggaaaccatcccgacctgcatgtggttcagcccgacggattatccattaaaaaggctcagatccaatcgcttcaggaagagttttccaaaacggggctggaatcgcataaaaagctgtacattatatcccatgcggatcaaatgaccacaaatgcggcaaacagtctgctgaagtttttagaggagccgagtcaagacaccatcgcaattctgattactgagcagctccaccgaatactggataccatcgtttcgagatgtcaggttctcccgttccagccgcttcagccgaaagccatagaagaaagactgattgaacaggaagtgagccctcacatggcccggctcttagcaaatatgacaaataatattgcggaagcagtcgaattaagtcgaaatgatgagtttgcagagtccagagcgaaagtgataaaattgtatgaagtcttacatcagcggaaaggacatgcctttttcttcattcaggatcagtgggtgccctttttcaaagaaaaaacccatcaagaaatgggtcttgatatgctcttattgatataccgtgatgtattatccatccaaattggaaatgaagataaactgatttatcaagacttattccaatcaataaaacagcatgcgctgcaatttacacaacaaagcgttacgaaccaaattctcgctgttttagaagcaaaaaaacggcttcattccaatgtgaatgtgcagggattaatggagcacttggtgttaacgttgcaggagggataagcttgtacaacgtaataggcgtccgctttaaaaaagcggggaaaatttattattttgatccgaatggatttgatatagaacaagacagctgcgtcattgttgaaaccgtaagaggtgtagaatacgggcaggttgtcatcgcaaataaacaagtggacgagcatgatgttgtgcttccgcttcgaaaggttattcgcgttgctgatgaacgcgatcttctcattgtagaagaaaacaaacaggaggccctgtccgcttttgaagtctgtcagaaaaaagtggctgaccacggcttagatatgaagctggttgatgttgaatttacgtttgaccgcaataaagtcattttttactttacggcagacggacgggttgatttcagggaattggtcaaagacttggcttctatctttaaaacgagaatcgaattgcgccaaatcggggtaagggacgaggcgaaaatgctcggcggtatcggaccatgcgggagaatgctttgctgctccacgttcctcggtgattttgaaccggtgtccatcaaaatggcgaaggatcaaaatttatcgttgaacccaacgaagatttccggtctgtgcggccgtttgatgtgctgtttgaagtatgaaaatgatgagtatgagacggcaaaagaacagctgccggatttaggcgaaatgattacgacggcaaacggccccgcaaaggttgtcggtcttaatattctggaacgggtgcttcaggtggaactgaagaatcgtgaaaaagtgatagaatatacttgggaagagctcttggaagagggcgtcgtatccgcacaaaccacagattaacgaggtgtggaaccttggataaaaaagagttatttgatactgtcataaacctggaggaacaaatcggttcgctgtaccgtcagctgggtgacttaaagcagcatatcggcgaaatgattgaagagaatcaccatcttcagcttgaaaataagcatttgcgtaagcggcttgatgacacgacggagcaaattgagaagttcaaagccgatcagaaagaaacaaaaacacagaaggcagagcagagtgatataggagaagggtacgacaatctggcccggctgtatcaagaaggctttcatatttgcaacgtccattatgggagcgtccgcaagggagattgccttttttgtctgtccttcttaaataaaaaataaggaaaaggcttccgctgatgtcggaagcctttttcaaagagtgccgaaaggaataagattatggtttcattacgtgatgatgaaagattggattacttattagcagaggatatgaaaatagtacagagtccgacggtcttcgctttttcattagatgccgtgctgctgtctaagtttgcatacgttccgattcaaaaggggaacattgttgatttatgcacggggaacggcattgtgccgcttttgctcagcacaaggtcaaaagccgatatcaccggggttgaaattcaggaacgcttgtatgatatggcgcttcgaagcgtggaatacaacgggctgggcggtcagatcagtctcattcatgatgatctgaaaaatatgccggaaagactcggacataataaatatgatgttgtcacctgcaatccgccttattttaaaacaccgaaagaggcggagcagaacatgaacgagcatctcagaatcgcaaggcacgaaatcctttgcacgcttgaagatgtgatttccgtcagcagcaaactgctgaagcaaggaggaaaagcggctctcgttcatcggccggggaggcttctggaaatctttgaactaatgaaagcataccgaatagaaccgaaacgggttcagtttatttatccaaaacaaggtaaagaagcgaataccattttggttgaaggaattaaaggcggccgccctgatctcaaaattcttcccccgctctttgtatataatgaacaaaatgaatatacgaaagagatccgcacgattttatatggagacaaatagtcatttcttttatgtgctgctgtgcaatgacaacagtctgtatgccggttatacaaatgatctgcaaaaacggctgaaaacccacaatgagggaaagggcgcgaaatatacaagggcgagaaggccggtttcgttatgccatgcggaatcatttgaaacaaaacgggaagcgatgcaggcggaataccgttttaagcagctgacccgaaagaaaaaagagcaatatatagaagaaaaacgacgcagcaaggaggctgtatatgttaagacgtcagatgagttttaacggaaaatctgaaatgggaactctgtaccttgttcctacaccgatcggcaatttggaggacatgacctttcgtgcagtagagacgctgaaatcggccgatgtcatagctgccgaagatacgagacagacgaaaaagctgtgccatgtttatgacatagaaacatctctcatcagctatcatgaacataataaagaaagcagcggccataaaatcattgaatggctgaaaagcggaaagaatgtggcattggtcagtgatgccggtatgccgacaatttccgacccgggggctgagattgtgagagatttcacccaaatcggcggatatgtcgttccgcttccgggtgcaaatgcggcattaaccgcgctgactgcatcagggatcaccccgcagccgtttttcttctacggattcttaaacagacaaaaaaaagaaaagaagaaagaactcgaaatcctgaaaaaacggcaggaaacgatgatattttacgaagcgccgcacagattaaaagaaacattaacagcaatgcatgacgttttgggtaatcgaaccatcgccgtcacgagggaattaacgaaaaagtatgaggaattcatcagaggaaccatcgccgaggtgcttgaatgggcaaatgaagatcaaatccgcggtgagttttgtctcgttgtcgaaggcaatcaaggcgctgaaccggatgaagaggaaaagccttggtgggcggagctttctgagaaagaacatgtggagcattacataaatgaaggatcttcttccaaacaggccataaaacaaacagcggtagatcgggacgtaccgaaacgcgagatttatgacgcttatcacattcaatcataaaaaaaaccgttcttgtgtcataacaagaacggtttttgtatgaaatagcttatttttggttttgaagctggttttgaatttcagagatgatttgctcagcgccttctttgctgagtaccaatttgccgccggcaagtttaaggttatcatcagaaacttcaccagttacttggcaagtcatgtttggtttatattttttaaggatgattttttcatcatcaacataaatttcaagagcgtctttttctgcgatgcccagtgtacggcgaagttcgatagggataacgacgcgtccaagttcatcaactttacgtacgataccagtagatttcattaacagtctcctcccgagagataattatttgtagtttatatttttcttcgtcattattcgacaaaattccttacattcctagcataacaaggtttccaataatcgtcaatctttttgtttgctattgtttgtaagaattagttcttatagtaagtaaagccttggaaatcctgaaataacaggctttttgactgctttttcgaacctattatcctactgaaaatccttttaaatcaagactttcgaaccaagatgttttatattagtagattatatacgacaaatttcgacatgttaagactttttttaatttcaataaaaatttttaattttatttactcttttacgcgcagtacgtatatatccttgatcttaaaggctaagatggtatcatagatagaggacaaatatcaatattgtatatcaaataaaaccgctctcgtcctttgggcgtgagcttttcgacattctgaatgggaggttgcaacatgccgcaagacaataatactttttatattacgaccccgatatattatccgagcggaaaattacatatcggccatgcttatactaccgtggccggcgatgcgatggcgcgttacaaaagattaaaaggatttgacgtacgctacttaaccggaacggatgagcacggacagaaaatccagcagaaagcggaggaagagaatatcacgcctcaagcttatgtggatcgcgcagttgctgaaatccaaaagctatggaagcagctcgacatttctcacgatgatttcatccggacgacggaaagccggcacaaagaaattatcgagaaagtgtttcaaaaacttcttgataatggtgacatttacctggatgagtatgagggctggtacagcatccctgatgaaacattctatacggaaacacagctggtggatgtggaacgaaatgagaagggtgaggttgtcggcggaaaaagccctgacagcggccacccggtcgaattaatcaaagaggagtcatacttcttccgcatgagcaaatatgcagaccgcctgctgaagttttatgaggaaaatccttctttcatccagcctgaatcacgcaaaaatgaaatgattaacaacttcattaaaccggggcttgaagatttggccgtttccagaacgacgttcgactggggcgtaaaagtgccgggaaatccgaagcatgtcgtgtatgtatggattgacgcactgttcaactatattacagcgctcggttacgatacggaaaatgatgagctttacaaaaagtactggccggctgacgtccaccttgtcggtaaagaaattgtccgttttcataccatttactggccgattatgctgatggcgcttgatctcccgctgcctaagcaagtattcgcgcatggctggttattgatgaaagacggaaaaatgtcgaaatcaaaaggaaatgtcgttgatccggtaacgttaattgaacgctacggcttggatgaacttcgctattacctgcttcgcgaagtaccgttcggttcagacggtgtctttacgccggaaggtttcgtagaacggattaattatgacttggcgaacgacttaggaaaccttctgaatcgtacagtcgcaatgatccaaaaatattttgacggcgagattggttcatatgaaggaaatgtgaccgattttgattcagagctttcttccgtagccggtgaaacggttaaagcttatgaaaaggcaatggaaaacatggagttttcagtcgctttatcaacgctatggcaattaatcagccgtacgaacaaatatattgatgaaactgctccgtgggtgcttgctaaagatcaggaaaaagaaaaagaattacgttctgtcatgtatcatttagctgaatcattgcgtatttcggccgtattgctacagcctttcttgacgcagacgcctgaaaaaatgttttcccagctcggagttgaggatcagtctcttaaagcttgggacagcattcagacattcggccaattgaagaatgtgaaagtgaaaaaaggggaaccgcttttccctcgtcttgaagctgaagaagaagtagcttacatcaagcaaaaaatgcaaggaactgctcctgctaaagaagaaaaggcggaagagccgcaagaagcagagcgtcttcctgaaattacgtttgatcaatttatggatacagaacttcgcgtcgcagaagtcttgtccgcagaaccggtgaaaaaagcagatcggctgctgaaattgcaaattgatctgggctttgaacagcgccaagttgtatcaggtatcgcgaagcattacacaccggatcagcttgtgggaatgaagatcatctgtgtaacgaatttaaaaccggtaaaactgagaggcgagctttctcaaggaatgatactggcgggagaatcggacggcgttctcaaagttgtagctgtcgaccagtcattaccgaaaggcactcgaattaaataataggggcaaaaggtgtttcacgtgtaacattccgtcgaacaccttttgtttttcaacaagaaaggagtttttatgatgctttttgatacacatgcgcacttaaatgccgaacaatttgacacagacttagaggaagtcattgcgcgtgcaaaggctgaaaaagttgaacgaattgtcgttgtcggattcgacaaacccactatcacgcgtgcgatggagctgattgaggaatatgactttatatacgctgcgatcggctggcatccggtagacgcaattgacatgacagaggaagatttatcatggattaaggaactgtcctctcacgaaaaagtcgtggcgatcggagagatgggccttgattaccactgggataaatcaccaaaagacattcagaaagaagtattccggaaacaaatcgctctcgccaaagaagtgaaccttccaattatcattcataatcgtgatgcaacggaagatgttgtcacaattttgaaagaagagggagcggaagaagtcggcggcattatgcactgctttacggggagcacggaggttgcacggcagtgtatggatatgaatttctatatttcattcggcggaccggttaccttcaaaaatgcgaagaaaccaaaagaagtagcaaaggaaattccgaatgaccgtttgctgattgaaacggactgtcctttcctgacaccgcatcctttccgcggcaaacgaaatgagccaagctacgtaaaatatgttgctgaacagctcgctgaattaaaagggctgacatatgaagaaattgcctcaattacaaccgaaaacgcaaaaagacttttccgcatgaactgacagaatgcgctgtcataacgtgtaaaagcttgtccgattcagtggatatgtaaaacggttctacaagcttccttctcctcataagataggttgtcgatatgtctctcttcctttttttgctttgtttttgcataatgagggatacgctgaaggtttttcatcttcgagatgggagggttgacagcattttagatactctatataatctctccgaggagaaggaggcgtttttcatcacacaaaaaatgaaaaaactgttttccgtaaagcttggtaaaagcaaggttattctgattgcagctattattctgctgggcggaaccgggactgcatacggggcacatgagctctcaaaacaatcagtttctgtttccatcaacggcaagaaaaagcaaatacgcactcatgcaaaaacggttggggaacttctggaagatttacatatagagacgagaaatgaagaccggattaccccgtctaagcagacagcattggcagacaacatgaatgtcgtgtatgatgctgcaaagcagatccgtgtgacaagaggcggagaagaaaagactttatggtcaacggcaaaaacagtcggcgcatttctgaacgaacagcatacacctgtgaatcagcacgataaaatagatccagcagcagatacgaaagtgacaaacggcatgaaagtcacggtcgacccggcttttcaggtcactgtaaatgatgcgggaaagaaaaagaaaatatggacgacttcgactacggtcgctgactttttaacgcagcataagatggacatgaaagacgaagataaagtaaaaccggcattacacgaaaagctcacaaaaaatcaggccggcatacaaatcactcgtatcgaaaaagtcaccgatgtagttgaggaaaaaatagcgtatcaagtgaaagaaaaagaagatgcgtctctcgacagcgggaaagaaaagatcgttcaaaaaggaaaagaaggcaaacttaaaaagcattttcatgttgtcaaagaaaatggaaaagaagtatcaagaaagcttgtcaaagaagaaacatctgaaaaaagcaaagatcagatcattgcggtcggcacaaagcggcacagtcccaagattgagcagctcagtgcacctgtgaaggcatcttcgggcgaaaccggatcttccggtaaagtgattaccgtgtcttccacggcttataccgcaagctgcagcggctgttccggccaaacggctacaggcgttaacctgacaagcaatccgaatgccaaagtcattgcggtagacccaagcgtcatcccgctcggcacaagagtccacgtagacggatacggggatgccgtggccgctgatacaggctcagccattaaaggaagacggattgatgtctttttccctgaaaaatcttcagcttaccgctggggaaagaaacaggtcaaaataaaaatcttaaattaattccgattcattcagagggttttgcgccctctgtttttttcgttataataggtaaagtgtattttcagtatattagacgtgacatgcaagcaaaggtttcgttttggatataaaaagtttttttggaggaagtaatgaaaattaaagaaattatagtagtcgagggacgcgatgacactgcgcgcataaaacttgccgttgatgcggatacgatcgagacaaacggttccgcaatcggagacgaagtcatcaggcagattcggctggcgcaggaaacgagaggggtcatcgtgctgacggacccggattttccgggggagaagatccggaaaaccatttctgaagcagtacccggctgtaaacacgcatttctgcccaaacatcttgccaaaccgaaaaacaagcgcggcattggcgttgagcacgcatccattgaaagcatcagagcatgtctggaaaatgtgcatgaagagatggaggcaaagccgagtgagatttcagctgaagatgtcatacaggccggtctgatcggcggaccggctgccaaaagacgccgcgaacgattgggcgacctgctgaagatcggctatacaaacggcaagcagcttcaaaaacggctgcaaatgtttcaaatcaaaagaagtgattttattgatgcgctcgatgctatgaggcaggaggaacaggatgaacaataaagatatcgcgacacctatcagaacgaaggaaattctgaaaaagtacggtttctcttttaaaaagagtctgggacagaatttcttaattgatacaaatatattggacagaattgtggaccatgcggaaattacggatcggaccggagtcattgaaatcgggcccggaatcggcgcgctgacagagcagcttgccaaacgggcgaaaaaggtcgtcgcgtttgaaattgatcagcgtctgctgcccattctcaatgatacgctgtctccgtatgacaatgtaacgattattcatcaagatgtgctgaaagcagacgtcaaatccgtcattgaagagcagtttcaggattgtgatgaaattatggtgacggcgaatctcccatattatgtgacgacgccgatcatcatgaagcttttggaagaacatcttccgttaaaaggaattgtcgtaatgctgcaaaaagaggtcgctgagcggatggccgctgatccttcctctaaggagtacggatcgctttccattgcggttcagttctatacggaggccaaaaccgtcatgaccgtaccgaaaacggtgtttgtgcctcagcctaatgtcgattccgccgtcatccgtctcttgcttcgtgacggcccggcggttgacgtcgataatgaaccgtttttcttccagctgattaaagcaagcttcgcacagcgccggaaaaccttgctgaacaaccttgtgaacaatcttccgggcggaaaagagaaaaaagctcaaattgaagaagttcttcaagaaacgaatattgatggaaagcggcgcggtgaatccctgtccatagaagaatttgcgctcttgtccaacggattgcataaagcccttttctaagagggctttttgttttgcgtcaccacttggactgccgctacataggctagaggagaaccttattcattcaactgcaagaaaagcttgaaacatcaagcgccgcagcggaaagaggtgcatttgccaagacttctttcatgatgaggcttagtctatttgtggagtgggtaacgtgcaatttcaaataggagatatggtagccaggaaatcctatcaaatggatgttttatttcgcattatcggtatagagcaaacaagcaacggaaattcaattgccatcctgcatggtgacgaagtcagattgattgcggatgctgatttttctgatttggagcctgtcagaaaagacgaacaggccatgagaaagaaaagagatgaaagcaggatgaatgaatctctcgagctgctccgccaggattataagctgcttcgggaaaaacaggaatattacgcgacaaatcaatatcagcatcaggagcactactttcatatgcccggaaaggtattgcatctggacggcgatgaggcctatttgaaaaagtgcctgaacttttatgaaaaaatcggtgtgccggtatacggaattcattgccatgagaaaaaaatgccggcgtcaattgacgagctgcttgataaatacaggccggatattttagtcatcaccggccatgatgcatattccaagcataagggaggcgtgaacgatttaagcgcctacaggcattccaaacactttgtcgaaaccgttcagagagcgaggcgtaaagtccctcatttggatcagctggtcatattcgcgggggcgtgccaatctcattttgagtctttaatcagagcgggcgcgaatttcgcaagttcgccgtcacgcgtcaatattcatgcgcttgacccggtatatattgtcgcgaaaatcagcttcactccgtttatggagcggatcaatgtatgggatgtcctgagaaatacgctgacgagagagaaagggctgggaggaattgaaacgaagggtgtgctgcgtgtcggtatgccgtataaatcaaatggatgagtgataaaacccgcatatatttcgctatgcgggttaattattttacatattgatacataaatttccggaacttgtgaaaaataacgcagaaatcaatagaattttgtcaaaataattttgttgacaatgacttattaacgttgatataatttaaattttatttgacaaaattgggctcttgttgtacaataaatgtagtgaggtggatgcaatggcgaagacgttgtccgatataaaaagatcgcttgatgggaatttaggtaaacggcttacgttaaaagcaaacggcggccgccgaaaaacgattgagcgttcgggcattttagctgagacgtacccttctgtttttgtgatacaactagatcaagacgagaattcgtttgaaagagtttcatacagttatgctgatattctgactgagactgttgaattgacattcaatgacgatgcggcaagctcagtagcattttaatgggcagtgaaccttttgtttactgctttttgttttgccttctaaagctcttctaattattccctcgaaagtttcagccgattaaacggaagctataggtgtcacatgttttatcgtggcgtgcacgaatggtgatcaattctataaaaggggttgtttcgtttgggcagacgtcgtggagttatgtcagatgagttcaaatatgagctggcgaaggaccttggtttttacgatacggtgaaaaacgagggctggggaggcattcgggcgcgtgacgccgggaatatggtaaagcgcgcgatcgagattgccgaacagcagatggcggctcagaaccaaaataaccgataatgcagtggcccgggggacaatccgttccccggttttttctatcggctgtcaaaaccggcgtcaatttcggataagtacctccgggtctccaaatgtgatacaatgttcatacttatgtttagatggagaagtaggtgaaagctatgcgtattttagaaaaagcgccggccaaaatcaatctgtccctcgatgtgacgagtaaacgcccggatggttatcacgaagtggagatgatcatgacgacaattgatttggcagatcggattgaactgacagaactgcccgaaaacgttatcagagtggcgtcgcataatcgctttgttccggatgatcaaaggaatctggcttatcaggcagccaaactgcttaaagaacggtttcaagttaaaaaaggcgtttcgattatgattacaaaggtgatccctgtagcggcagggcttgccggcggaagcagcgatgcggcagctacgctcagagggctgaacaggctttgggatttaaagctttctgtcgaagagcttgcagagcttggagctgaaatcggttcagacgtgtccttctgtgtatacggaggcactgccctggcaaccggacgcggtgagaagatcaggcacatcagtgctccgcctcattgctgggtcatgctcgccaaaccgacgatcggggtatcgactgccgaagtgtaccgccggctgaacttacagcaggttcggcatcctgatgtgcaggcgatgattgacgcgattgaagaaaaaagcttccaaaaggtatgcggacaattaggaaacgtattggagtcggttacgctcagcctccatcccgaggtggcgatgattaaaaatcaaatgaaacgcttcggcgctgatgcggtgttaatgagcggaagcggaccgactgtattcggtttggttcaatacgaatcaaaggtgcagcggatttataacgggttaagaggtttctgtgatcaagtgtacgcggtgcggatgatcggcgaacagaatgctcttgattaaatccgtatgttaagttatattatttttaaattattcggattttgggggtaagttcatgaagtttcgtcgcagcggcagattggtggacttaacaaattatttgttaacccatccgcatgaattaataccgttaacgtttttctcagaacggtatcaatcagcaaagtcatcaatcagtgaagatttaacgattattaaacagacctttgaacagcaaggcattgggacgctgcttacagtgccgggagctgccggaggcgtcaaatacattccgaaagtgaaacaggctgaagcagaagcgtttatacaggagctgggacagtctttagtaaatcctgagcgtatccttccgggcggttatgtatatttaacggatatcttaggaaaaccatctgtcctctctcatgtaggcaggctttttgcttccgtttttgcggagcgggagattgatgtggtgatgaccgttgcgacaaaaggaatccctcttgcttacgcagcggccagttatctgaacgttccggttgtcatcgtacgaaaggacaataaagtgactgaaggctccacggtgagcatcaattatgtatcaggatcgtctaaccgcattcaaacaatgtcgcttgcgaaaagaagtttggctacgggttcgaacgttttgattattgacgactttatgaaagccggcggcaccattaacggcatgatcagcctgcttgatgagtttaatgcaaacgtcgcggggataggcgtcttggttgaagccgagggagtgaatgaacggcttgtcgatgaatacatgtcactgctcacgctttcaaccatcaatatgaaagacaaaacgattgagattcaaaacggcaattttctgcgattttttaaagaacagcatttaaagaatggggagacagaaaaatgactaaagcaatccatacgaaacacgcgccggcagcgatcgggccatattcacagggaatcatcgtaaacaacatgttttacagctcaggccagattcctcttactgctgaaggagaaatggtaaacggtgatatcacagaacaaacgcatcaggtgttcagcaatttaaaagctgtgctgaaagaagcgggcgcttctctcgagacggttgtcaaagcaacggtatttattgctgatatggagcagtttgcggaagtgaatgaagtgtacggacaatactttgatgtacataagccggcaaggtcttgtgtggaagtggcgagactgccgaaagacgctctcgtggaaattgaagtcattgcgctggtgaaatcttaaatctcagaaaagtggttccggtctccgggatcactttttttatgcagtatatgatccccaaatatggtttatcacctaattgtgtatgtatatcctatattttcaaaaaaactttttgaaacgtgcaggaatttaaaaagaatcgtggaattgttagactaatgcttttatatagggaaaaggtggtgaactactgtggaagttactgacgtaagattacgccgcgtgaataccgatggtcgcatgagagcgattgcatccatcacgctggatcacgaatttgtcgtacatgatattcgtgtgattgatggaaacaatggtcttttcgttgcgatgccgagtaaacgcacccctgatggagaattccgcgatattgctcatcctattaattccagcacgcggggcaagatccaggatgctgttttaaatgagtatcatcgtttgggtgattctgaagcattagaatatgaagaagccggggcttcttaaacataacaaaatgtaaggactgctgataaaggctgacacaaggccttttccggcagtccttttttaaatctgatttttcagtaataaagcgattacatagaaaattcttgcactttttgatgtcttcttgaaatcaacagctatttaggatatatttttctatggataaaagggatattggaggccattaaatggataagcggtttgcagtgattttagctgccggaaaaggaacgagaatgaaatcgaagctttataaggtccttcatccggtatgcggaaagcctatggtagagcacgtcgcagacgaagctctgaaattatctttagcgaagcttgtcaccatcgtaggacacggcgccgaagatgtgaagaagcagctcggacagaaaagcgattacgctctccaagcagaacagctcggtacggctcatgcggtcaagcaggcaaaaccatttcttcacggagaaaagggtgtcacgatcgttatttgcggcgatacaccgcttctgacggcggagacgatggaagccatgctgaatgaacatacagacaaaggtgcaaaagccacggtgttaacggccgttgccgacgatcccgccggatacggaagaatcatccgcagtgaagacggcgccgttcaaaaaatcgtggagcacaaggatgcttcggagcaagaacgtcttgtgaaagaaatcaacacgggaacgtactgttttgataacgaggctctttttcgtgtcatcgaacaggtttcgaatgaaaatgcccaaggcgagtattatctgccggatgtgatcgaaatcctcaaagacgaaggcgaaactgttgccgcttaccagactggtaacttccaagagacgctcggagtgaatgatagagtcgctctttctcaggctgaaatgtatatgaaagagcgtattaacagacggcatatgcagaacggagtcactttaatcgatccgatgaatacgtacatctcacctgacgcacgtatcggacaagatacagttatttatcccggaactgtgttaaagggacaagctgaaatcggcgatgaatgtgtcatcggccctcacactgagatagaggacagttcaatcggcagccgcactgtgattaaacaatccgttgtcaaccgcagcaaagttgggaatgatgtaaatatcggtccttttgctcacatcagacccgattccgcaatcggcaatgaagtgaagatcggaaactttgttgaaatcaagaaaacacaattcggcgaccgaagcaaagcatctcatttaagctatatcggtgatgccgaagtgggcacggatgtgaatctgggctgcggctccatcacggtcaattatgatgggaagaaaaaatatttaaccaagattgaagacggcgcttttataggctgcaactccaatctggtcgctcctgtcacagtgggagaaggcgcgtatgtcgctgcgggttcaaccgtaactgaagatgtgccgggcgaagcgcttgccattgccagagcaagacaagtaaataaagaagattatgtgaaaaatattcataaaaaataatcctaaaatcggaggtttaccatgtctaacgaatacggagataagaatttaaagattttttctttgaattcaaatccagaacttgcaaaagaaatcgcggataatgtaggggttcaattaggaaagtgctctgttacaagattcagtgacggagaggtccagatcaacatagaagaaagtattcgcggctgtgattgctatatcattcagtctacaagtgcgccggttaatgagcacattatggaattgctgattatggttgacgctctaaagcgcgcttccgcgaaaacaatcaacattgtgattccgtactacggttatgcgcgccaggacagaaaagcaagatcacgtgaaccgattacggcaaaactttttgcaaacctgcttgaaacagcgggtgcgacacgcgtgattgcgcttgatttacacgcgccgcaaattcaaggtttctttgatattccgattgaccacttaatgggtgttccgattttaggccattactttgaaggtaaagacttgaaagatatcgttattgtttctcctgaccacggcggtgtgacgcgcgcccgcaaacttgcggaccgtctgaaagcgccgatcgcgattatcgacaaacgccgtcctagaccgaatgaggtagaagtgatgaacatcgtcggtaacgtggaaggaaaaacagcgattctgatcgatgatattattgatacggccggcacaatcacacttgccgctaacgcgctggttgaaaacggagctgcagaagtgtatgcatgctgtacgcaccctgtattgtcaggccctgccgttgagcggatcaataactctaaaatcaaggagcttgtcgtaacgaacagcattaagcttcctgatgagaaaaaaatcgaccgctttaagcagctttctgtcggaccgcttctggctgaagcgattatccgcgttcacgagaaacaatctgtcagctatttattcagctaaaccgaaactttaaggtttaaatcccagttattgtgggtattgttctaataggacgataaaacgataattaggatggtgctgaatatggcaactttaaaagcaaatgaaagaacagattttaaacgttcgacgcttcggaaaatccgtcattcaggacatgttccagggattatatacggtaaagaaataacgaatacgcctgtctctttagacagtgtcgaattgcttaaaacattgcgggacgaaggaaaaaacacgattatcacaattgatgtcaacggaaatcagcaatcggttatggtgactgatcttcagacagacccgctcaaaaacgaattgacgcacgccgattttcaagtcgtgaatatgagtgaggagctcgaggccgaggtgccgattcagctgacgggagaggcgaaaggagtcaaagacggaggcgttatccagcagccgctgcatgagctttcgatcaaggctaagccgaaggacatccctcagacaattaatgttgatatttccgggcttgaaatgaatgatgtgctgaccatcgcagatctgactgctgacggcaattatacatttacaaacgacccggaagaagtcgtggcttccatccttcctcctaagcaggaagcattcgaagaagatgcagaaccgtctcctgaggaagagcccgaaggagaaaatcaataagcgctttaagacgtaacccgcccgaggttacgtcttttgtgctagaatgagaagaattacagcgatgttgagggaggatttacgatgcttgtgattgccggtctcggtaacccgggaaaaacctatgagaacacgagacataatgtcggctttatggccattgacgagctttctaaagaatggaatattgaactgaataaaacgaaattcaacggactttacggaatggggtttgtttccggaaaaaaagttctacttgttaaaccgcttacatatatgaatttatcaggagaatgtttgcggccgctgctggattattatgatgccgatcatgaagatctgaaagtcatatacgatgaccttgatcttccgacgggaaaaatcaggcttcggacgaaggggagcgcaggcggacataacggaattaaatcgcttatacagcacctcggaacccctgaatttgaccgggtcagaatcggaatcggccgccccgttaacggaatgaaagtcgttgactatgtactgggagcttttacgaaggaagaagcgccgcatatcaatgatgccgtctcaaaaaccgtaaaagcctgcgaagcttccttaacgaaaccatttttagaagtcatgaacgaatttaatgcaaatgtataagataaataatgggagaccatactagggaaaaatgattttttcacatcaggaggtccaacgtatggctttgcattatttctgccgccactgcggctttaaggtagggagcctggaatattcgacggtgccgacacagtcacttggatttcagcacttaacaaatgaggaaagaaacgatatgatttcatataaagacaatggagatgtccatgttcttacaatttgtgaagactgccaagaggcgctggaacgcaatccgcactaccatgaacacaacacatttattcaataagaagctttggtgtagattctagaccaaagcgtttttctgttcttgcagaaaatagagaggagggcccatatggacaacattcaaacctttattaaagaaagcgatgattttaaatccattgtcaacggtttacatgaggggctgaaggaacagctgcttgcgggtctgtcaggttccgcgcgttctgtttttacctccgcccttgcacaggaaacgaaaaggccgattttctttatcacccataatttatatcaggcccaaaaagtgacggaagatctgacggcgcttctcggggatcaatctgtttttttataccccgtgaatgaattgatttcttcagaaattgcggtagcgagtcctgaactgcgcgctcagcggcttgatgtcattaatagattaacaaacggagaagcgccggtcgttgtggcgcccgttgcggcagtgagaagaatgcttccgccgaaggagctgtggaaaagcagccagctcgtcatttcactcggagacgatatagaaccggaccagctgtccgcgcgtcttgtagaggtggggtatgagcgttccgatatggtttctgcacccggtgaattcagtattcgcggcggaattatcgacatttatccgctgacgtcggagcatccggtgcgaattgaactgtttgatacggaggtcgattccatcagaagcttcaattctgatgaccagagatcaatcgagacgcttaaacatgtggcgatcggaccggcgaaggaattgatcatcagggcggaagaaaaagcccgggcaatggaaaggctcgataaagggcttgccgacagtctgaaaaagctgaagcaggacaaacaaaaggaaatgcttcatatcaatatctcacatgataaagaacggttatcaacgggacagactgatcaggaacttgtgaagtatctctcgtacttttacgaaaaacctgctagtttgctagattatacaccggaagacacgttgttactgttagacgaggtcagccgcattcatgaaatggaggatcagctgcaaaaagaagaggccgaatttacgacaagtctgctcgaggaagggaaaattctgcatgacattcatttatccttcagctttcaggagcttatgagcgaaaagcggcgcccggctatttattattcattatttttgcgtcatgtccagcatacaagccctcagaatatcgtgaatgtgacaagccggcagatgcagagttttcacgggcagatgaatgtcctctcaggtgaaatggagcgctttaagaaatcaaacttcaccgtcgtctttttaggcgcaaataaggacagaaccgacagattggcatccgtgctggctgattacgaaattgaagccgcgaaaacggacagctccaaagcgcttgtgcaaggacaggtctatgtcatggaaggcgagctgcaatccggttttgaactgccgctgatgaagctggccgtcattacggaggaagagctgttcaaaaaccgaatcaagaaaaagccgagaaagcagaagctgacaaatgccgaacggatcaaaagctattccgagcttcaggtcggtgactatgtcgtccacgtcaaccacgggatcggtaagtatttggggatcgaaacactggaaatcaaaggcattcataaagattacctcaacattcattatcagggcagcgataagctgtatgtccctgtagaacaaatcgatcaggtgcagaagtatgtcggctctgaaggaaaagaaccgaagctttataaactgggcggcagtgaatggaaacgggtgaagaaaaaagttgaaaactccgttcaggatattgccgatgatctgattaagctttatgcggaacgggaagcaagcaaaggctatgcgttctcgcccgatcatgaaatgcagcggcagttcgaatctgctttcccttatcaggaaacagaggaccagctccgttccattcaggagattaaaaaggatatggaaagagaacgcccgatggaccgtttgctttgcggtgatgtgggttacgggaagacggaggtagccatccgagcggcctttaaagcgatcgcagacggaaagcaggtcgcgcttcttgtgccgacgacaatactcgcgcagcagcattatgaaaccattacggagcgttttcaggactatccgattaacatcggtcttctcagccgattcagaacgagaaaagaatccaatgaaacgattaaaggcctgaaaaacggaacggtagacatcgtaatcggaacccacaggctcttatctaaagacgtcgtctataaagatctcggcttgctcatcattgatgaagagcagcgcttcggcgtaacgcataaggaaaaaatcaaacagatcaaagccaatgtcgatgtactgactcttacagcgacgccgattccgcgtacgcttcatatgtccatgctcggtgtgcgggatttatccgttattgaaacgccgccggaaaaccgtttccctgttcagacatatgtcgtggaatacaacggtgcgcttgtacgagaagctatcgaaagagaactggcgcgcggaggacaggtatatttcctgtacaaccgcgtggatgacatcgagcggaaggctgatgaaatttccatgcttgttcccgatgcgaaagtggcatatgcccacggaaaaatgaccgaaaatgaattggaaagcgtcatgctcaattttctggaaggggaatcagacgtccttgtcagcacgactattattgagacaggcgtagatataccaaatgtcaataccttgattgtgttcgacggagacaaaatggggctgtctcagctgtatcagctgagaggacgggtcggccgttccaaccgcgtcgcttacgcttattttacgtaccgcagagacaaagtgcttactgaggtggcggaaaaacggctgcaggcgattaaagaatttaccgagctgggatcaggctttaaaatcgccatgcgtgacttgacgatcaggggagcggggaaccttctcggcgcccagcagcacggctttatcgactcagtcggttttgacctgtactcgcaaatgctcaaggaagcgattgaagagcggaaaggcgatattccgaaaagcgaacagtttgagacagaaatcgatatcgagcttgacgcgtatattcctgaaaactatatacaagacggcaagcaaaaaatcgacatgtataaacgcttcaggtcaatcgccacaattgaggagaaaaatgagctccaagatgaaatcatcgacaggttcggcagctatcctaaagaagttgaatggctgtttacggttgctgagatgaaggtgtacggaaaatatgaacgcgtcgaactcatcaagcaggataaagacgcgatcagatttaccatttctgaagaggccagcgcacagattgacggccagaaattattcgaactcggcaataaatacggccggcagatcggactgggaatggaagggaaaaagctgaaaatctcagtacagacgaaaggccgcaaaacggaagagtggctggagaccgtgctcggcatgctgaaaggccttcagaatgtgaagaaagaaacaatcgcgtcttcataaaaattgttactctctggtgtatattacatttgatgtgacggatactaatttcaagcgagtggcggaagctacataaagtaaagagctttagtactttcccttaaatatcatcacatgaaagagaggcaccagagagatgaaagctacaggtatcgtacgtcgtattgatgatctaggacgggtcgtcattcctaaagaaattcggagaacactgcgaatcagggaaggagacccgcttgaaatattcgttgaccgcgacggagaagttatattgaaaaaatattctcctatcagtgagcttggcgattttgcgaaagaatatgcagatgcattgtatgacagtctcggccattccgtcttgatttgcgaccgtgacgcgtatattgccgtttcgggcagttcgaaaaaagaatttctgaataaagccatcagcgatttgctcgaaaaaacgatggatcagcgcagctcagtggtagaaaacgacgtgaagtccgcgcagcttgtgaatgacattgatgaagatatgagctcctatacaatagctccgatcgtggcaaatggcgatcctatcggtgccgtggtcatcttttccaaggaacaggcgcttggagaagtagaacataaagcggtagaaacggcagccagttttttggcgagacaaatggagcagtaggtcttattaccattattgaaataaaaaaacggggaaagaacagctcttatacaagtgctgttctttttcatattcttatgtgctctctatcggttcggccgttaggattgtgatataataagctcgttttatagacgtaattttctagcggctggaaggagcttttggatgaacgattcagttggcgccaagcggcaatcggcatggaaaggtgcttttgtgctcgtcgttgcgggcatcgtgacgaagatattaagcgccgtgtacagggttccttttcagaatattgtcggtgacgtcggattttacatttatcagcaggtgtatccgtttttagggatcgcggtcatgctgtcaacatccggttttccggtgatcatctcaaaattaatgaacgattatagcgatcataaacaaaaaataatgaaaatttccgccctttatgtcacggcggccggacttgttctgtttgcgctcatgtatgccggcgcggcgccgttggccggttttatgggtgatgcccgccttgtgatgctgataagggtcgcggcgttcgctttcatactgtttccgtttacggcggttttccgggggtatttccaaggcgtgcatgatatgatgccgtcagccttatcccagattacggaacagcttcttcgggtggcggtgcttctcggtttatccttctggcttttgaaaagcgggcgttcattatacgcggcgggtgcgggggcggcctcgggatcaattgccgggagctttgcggccctttgtgtattggctgttttctggtataagcgggaagaaacaaagaaagacggcggacatatcgaaacggccgtcattgtaaaaaagctgctgctttattcagtcaccatctgtatcagcagtgtactcatgcttttgattcagcttgtagacgccttaaacttatattcactgctttcagacgggacggagagccatgccgcgaaacagctgaaaggcatatatgaccgcggacagccgctccttcagctgggaaccgtgtttgccgtcagtctcgccgcgtccttggttccttcaatttcaaaagcggtgcatgagaacaagccgtttatcataaaagagaaagcgacatctgccgtcaagctctgccttgcggtagggatcggtgcatcagccgggcttttttgcattttagaaccggtgaatatcatgcttttccaaaacagtgaggggacgcagaccttacaaatattcagcttatctatcttttttgcctcaattgcgcttacggcagccgcaattctgcaaggagcgggacataccgttttccccgccgtatccgttttggcgggaggggcgctgaaatgggtgctgaatgtttggctggtccccggctggggtattacaggagcggcactggcgaccgtcttggcatttgccgcagttgcgtgcctgaatctccggagaatttggtcgaagggatggctgacgaatatcggaggcgtgattgcccgtctgtgctggtgcagtctgctgatggtcttctttttggtcgtatatatgaagctttggcagttatttgttcctgtcagcaggggcggagctgtatgtgagagtctgtctgcgtcaatcatcggagggctattgtttatttattgtatgataagaatgaagattttcacggacgaagagctgagcggtcttcctttcggcagtgctttaagcaaattgaaaaagaggagagaaaaacatggcaggtaatattacggtcgtcggcctcggcgccggagacatggatcagttgacagtgggcgtacataagctgctgactcaggcgaagcatttatatataagaacgaaagaccaccctttgatttcggaattagagcaagagacggaagcggacatccggtattttgatgatatttatgaaaaacatgatcagtttgaagcggtctatgaagagatcacggacattctgtttgaaaaagcgaagcaagaggatgtcgtctacgctgtacccgggcatccgtttgtcgctgagaaaaccgttcagctgttatttgaacgccgggaagaacaacagatagatgttcataccgccggagggcaaagctttctggatgccacttttaatgcgttgcgaattgatccgattgaagggtttcaatttacggatgcgcaaacaatgacgccggatgagctcgaactccggcatcacctgatcatctgccaggtttatgaccaaatgacggcctctgaggtgaagctgacgctcatggagaaattgcctgacgactatgaagtggtcatcgttacggcagccgggagcaagggagaaaagatgatcaaggtgcctttgtttgaacttgaccgcaatgtagaaataaataacttaacaagcgtgtatgttccgccgattaaaaaagaagaactcctttaccaggaattttctgcattccgaagtattattcgcgagcttcgcgggccgaacggctgtccgtgggatcaaaagcagacacaccagtcattaaagaaatatatgattgaggaatgctacgaactgcttgaggccattgacgaagaggacacggatcacatgatagaagaactcggggacgtcatgcttcaggttatgctgcacgcccagatcggagaagacgaggggtatttctcaattgatgatgtcatcagagacatcagtgcgaagatggtcagacggcacccgcatgtgtttaaggatgttaaggttcaggatgaacatgatgtcgtcgccaactgggaagaaatcaaaaaggcggaaaagcaaacaacatcctcttcattgctggatgccgtgccgaaaacactgccttctcttgcgaaagccgccaagcttcagaaaaaagccgcaaaaaccggctttgactgggataacgttcaggacatatgggataaagtaaatgaagagctgaaggaattttctgcagaggcttccgccgaatcagcagatgaaatcagcttaaaagctgaattcggcgatgttttatttgcattggtcaatatcggccgatactataaaattgagcctgaggaagcgctcgccatgacaaatgacaaattccgcagacgctttgcttatattgagaaagaagcggcagcaaagggccttgaattgaccgcaatgtcacttgaggaaatggacaaattgtgggatgaagcaaaagaaatggagaggagattctgatatgagacttgataaatttttaaaagtatccagattaattaagcgacgcacattggcgaaagaggtcgccgatcaagggagaatcaccgttaacgggaatcaggcaaaagccagctcagacgtaaaagccggtgatgaactgaaggtccgcttcgggcagaagcttgtcaccgtgaaggtaaatgaattgaaagaaacaacgaaaaaagaagaagccgcgggcatgtatacaatcgtcaaagaagaaaaactcggcgaataggcttgttctaaacaaggctcccgcctcatacaatgcagtaataatgctaaaagtatcgaggatatgggggctgaatagatgaattcatattatgagcaaaaaggttcttcttctgttccggaacagcatgatgtaacgatgaaagggagaaagcatttagacatttcgggcgtcaagcatgtggaaagttttgataacgaagagtttttgctggaaacggttatgggaatgctttccgtcagaggcgagaatctgcagatgaaaaaccttgatgtggaaaaagggattgtatctataaaaggcagggtgtttgaccttgtatatttagacgagcagcaaggggataaagctaaagggttttttagcaagttgtttaaatgacgctgacgacccaattttatacgatgctggcaatgaccggtatgggcgcctggctcggagcgtcgcttgatacatacaggctgtttgtcagccgcgccaaaacggccagatggctgttattcattcatgacattctcttttggattgtacaaggtctgctgtttttctatgtgctgctcaacgtgaatgaaggggaactcagggtatacattttcttggctgtcttactgggtattgcgacgtaccaaagcctgtttaaacgaatgtatataaaaatactgaaatttgccattcatcttgccgtgtctctttaccaattcgcaaaaaagctcattcagcacgtgctgttccgtccggtgcttctgctctttaagctgctcatcgggctgatcacggttatttctttatactcctatcgggtgagtgccttttttgcgaagtgtctttttaagatcgtagcgtttttgctgtatccgctgtttttcctgttgaaacaattattgaaacttcttcctgaaaagtggcgtcttactttcaaacgttattttcaaaaaagtgcaggatttttacaaaagagcaagaaactaatcataacaatcagatcgaccatgatacgtattttgaaaaggtgaaaggaggaccgtctggtttgaatctatctagggaacgtacaataactgaaattcaaaacgactataaagagcaggttgaacggcaatcccagcttatgaaaagaaggcggaaagggcttttcagacggttgatcgtattcggcgcccttgtgttgttgacggctattgtcttagcgggttctctgtggtcacagacctcttcccttagcgcaaacgaagaaaaaaaggctcagctggaaaaacaagttaaagaattgaatgcgaaacaggctgatttaaaagatgaaatttccaaattaaaggatgaggattacgtcacagagcttgccagaagagacttgtttatgtcaggaaatggtgagattctctttaatgtagaaaagaagagcaagtagccttgttgacacttaaatttttatttaggtataattaaacaaacgatctttttataagcctaaggaggagcactttttttatgtcgattgaagttggcagcaagttgcaagggaaaataacaggtattacaaatttcggagcatttgttgaattgcctggaggctcaaccggtctcgttcatatcagtgaggtagccgataattatgtaaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataacttgctgctttctataaatacatggagcatccgtctatcccagcgggtgctttttttgtatacgcgcatgtagtcagaaaattaaaactttaaagtttctgttgacggaatgaagaaacctttgtattatataacttgtgcttataagcacctatatggcggtgtagctcagctggctagagcgtacggttcatacccgtgaggtcgggggttcgatcccctccgccgctaccatatatatctggcccgttggtcaagcggttaagacaccgccctttcacggcggtaacacgggttcgaatcccgtacgggtcatcaagcgaatcggcttctgttgcagaagccgattttttcatatttagacaactttttgagaaatgtcggaggaaatacaaaaggaaaggggaacaagggagaaagcgtcgaagagttctttggaattgttaccttcttttgacaaaatcctatctgggctttcatttataatgacaagcaacgaataaaacaggtgggggatgagagcaatggaaaaagcggaaagaagagtgaacgggccgatggcgggacaagctctggaaaaactgcaatcgttttttgaaaaggcggcaaagcttacagtccatcaagcgcattcactttttttctataagggtttcatttatgtcgtgatcggttttttacttggacgggctttcatattatctgaggttcttccatttgcactgccgtttttcggagcgatgcttttgatcagaagagataaagccttctatgcttgtctgtctttacttgcgggcgctttaaccatttcgccgaaacactctttattgattctcacagctttggccgtcttcactctattttcaaaaatcggtacatatatcgtgcaggaccgggtgaagatgctgccgatcgtggtgtttttctctatggctgccgcgagaatcggatttgtttattttgaaagcggcgcttttaccacctatgattatgtgatggctgttgtcgaggcgggcctggcctttattttgacgctgatctttttacaaagcctgccgattttcacgatcaaaaaagtgaagcaatcgttaaaaatagaagaaatcatctgttttatgatcttgatcgcatccgttttaaccgggcttgccggtgtttcatttcagggaatgcaggctgaacatatcctggcccgctatgtcgtgctgagtttttcctttgtcggcggggcaagcatcggctgtacggtcggtgttgtgaccggactgatcctcgggcttgcgaatatcgggaatctctatcaaatgagtctgcttgcgttttccgggcttcttggcgggctgctgaaagaaggaaagaaagccggcgccgcagtcggattggtgatcggctcactgctgatttcattatatggtgaagggtctgccggattaatgaccactctttatgaatctttgattgctgttgtattgtttttgattacgccccaatcgattacgaaaaaggtggcgcgatacataccgggcactgctgagcacagtcaggagcaacagcagtacgcgaggaaaatcagagatgtcaccgcccagaaagtagaccagttctccaatgtctttcatgccttgtcggagagcttcgccacctttcatcagacgtcttccgatgagcaggcggaagaaggggaagtggatctctttttaagcaaaatcaccgagcattcctgccaatcctgctataagaaaagcaaatgctgggttcaaaactttgataaaacatatgacttaatgaaacaagttatgcatgaaacagaagaaaagcagtatgcctcaaaccgcagattgaaaaaagagtttcaacagcactgttccaaatccagacaggtggaagagctgattgaggacgaacttgcccaccatcacgcccatctgacactgaagagaaaagttcaggacagcaggaggcttgttgccgagcagctgttgggggtttctgaggtcatggcggacttttctcgggaaataaaacgggagagggagcagcattttattcaggaagaacaaatgatagaggcgcttcagcatttcggaatcgagattcagcatgtcgagatatacagcttggagcagggcaatattgatatcgaaatgacaatcccgttcagcggaggacacggcgagagtgagaaaattatcgccccgatgctgtctgacattcttgaggagcagatacttgtcaaaagcgaacagcactcggctcatccgaatggctacagccatgttgcgttcggttcgaccaaatcgtaccgggtatcgacaggcgcggctcatgcggcaaaaggcggcggccttgtctccggcgacagctacagcatgatggaactgggggcgagaaaatatgcggccgcaatcagtgacggcatgggcaatggggcgagggctcattatgagagcaacgaaacgattaagctgctcgaaaaaattctcgaatcaggtattgatgaaaaaatagcgatcaaaacgatcaacagtattctgtctttacggacgacagacgaaatctactcaactctcgatctttctatcattgatcttcaggatgcaagctgcaaattcttgaaggtcggttcaacgccgagttttatcaagcggggagatcaagtcatgaaagtgcaggccagcaatctgccgatcggtatcatcaatgaatttgatgtggaggttgtaagtgaacagttaaaagcgggagatctgctcgtcatgatgagtgacggtatttttgaaggaccgaagcacgttgaaaaccacgacctgtggatgaaacggaaaatgaaagggctgaaaaccgaagatccgcaggaaatcgctgatatattaatggaagaggtcatcagaacgcgttccggccaaatcgaagacgacatgacggtggttgttgtccggattgatcacaacacgccgaaatgggcttccataccggtgccggcggtattccaaaataaaaaggagatttcttaatcctttcgtataaatcactttccttctggcgaagatgggactaatcgtatcaccgggaggaatgtatgtgaataagggacatttaaatcaagttctgctgattacagatggctgctccaatcatggtgaagacccgattgcaatggcggctttcgccaaggagcaggggattacggtgaatgttatagggattatggaagaaaacgcgattgaccaagaggcaatgaaggaagttgaaggcatcgccatggccggtggcggcgtccatcaagttgtatatgcgtcacaattgtctcagacggttcaaatggtgacgaaaaaagcaatgacccagacgctgcaaggtgtcgtcaatcaagagcttaaacaaatcttagggaaaaacgttgaaatggaagagctttctccggaaaaacgcggcgaagtgatggaagtggttgatgaactcggagaaacagttcatctgcaggtgcttgtgctggttgatacgagtgcgagtatggcgccgaaactgccgacggtgaaagaagcgctgattgatctttccatcagtttaaattcccgggccggacaaaatgaatttgccatgtgtatatttcccgggaaaagccaggaagttgagcttgtgctgaattggacgccgaagcttgaatccctttccgcgctctttgcgaagctgtcgaccggcggtatcacccctacgggccccgctatcagggaagcgacgcagcagtttgagagaatccgctcaagaaggagcatgttggcagatgatgaacgacgctttaacgagtttggcatgtagtttggcaccggggacggcaattcagggcaaatggaacggcaaatcctacagattgctcaaacagcttggaaaaggggctaacggtattgtatatctggcagaagcatcaggcgggcaggttgctttgaaaataagcagcgatagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcctgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacaggggctattgggggtatggaacaagaaaagcagaaccatcctatgacctgtttgctgtcgcaatgatcatgatccactgtgtccagaagaaagagtgcaaaaagtcaggacagccgaaagaacagcttcgttctatcattgaaggccacccgtttctgaacaagtataagaaggttctgttttctgctttaaacggccaatatccgtctgcggaagccatgaagcatgacatcctggcggcggggcagagcgccgggagtaaaaggaaagccgccgccaagcctaagccgccgcaatcaaaaccgcggcagggcactgtatctcaaacgcggtataaacctaaacaaaaacccgcaaagcacaatggtttgtttgaaacaacgcttattttaatcagcgttctcgccctttatttcgcttacatcgtcttttttctcatctaatgccggccggacgcctgcgctcatgcttcttctttgcttggagggaatgaaagtgataggatatgtatatctttaaaaaacctgctcattgtgagggggacattgtgaaaagcgtggaagattttttcaaaacatatcatcttcaggcggagggagaaacgattattgccggggtctccggaggccctgattcaatggcgcttctcagtatgctgaataagcacttcgggcattcttccgttatcatagcggcgcatgtcgaccatcagttcaggggtcctgaatctgaagaagatatgaagtttgtgcagtcatattgcgaagcggaacacatcctctgcgaaacggtacagattgatgtttctgcatacgcaaagaagaataagctgaacaagcaggctgccgcgcgtgattgcagatatcagtttttcgaagatctgatgacaaaacaccaagcgaagtttttggcgctggctcatcacggcgatgaccaggttgagacaatgctcatgaggcttgcgaaaggtacgctcggcgcagggctcgcgggaatgcagcccgtccgcgaatttgcatccggctggctgatcaggcctttcctctatgcggaaaaggatgaaatcctagaatactgccgtcaagaagggctcagctacagaacggatgagagcaatgcaaaagacgattatacaagaaacagattcagaaagaccgtgcttccttttttaaaacaagaatcacctgacgttcataaaatgtttcaaaaggtgagtgaagcactgacagaagacgaacaatacttgcagtcattaacgaaagaacgaatgaataaggttattacaagcaagtctgacacatcggttgaagtcgattcctctcaattgcttgcccttccgatacctttacaaagaagaggagttcaactaatattaaactatctttatgaaaacgttccatcgtcgttttccgcccgccacatacagcagtttctggaatgggcggaaaatggaagcgcctcgggagtgcttgattttccgaaagggctgagggtggtcaaatcatatcagacatgtttgtttacatttgaacaatggcaatgtgaaaaggttccctttgagctgcagctgcaaggagcggaaggcgagactgctgttctccccaacggctttatgatagaggtggctgatcaggctgaccctcatatcaaaaatgggaatgctgtttttatgacaagcagaaataaggtgcaatttcctttaacaatccggacgagaaaaatcggcgaccggattaaacttaaagggatgaatggctcgaaaaaggtaaaagatatatttattgatcataaactgcctctgcgggatcgggacgaatggccgattgtaacggatgcgagcggtgaaattatctggctgcctggcttgaaaaaatccatctttgacgatcttgtgatttcaaacagtgaccgcattgtattacaatatagacagcatgaaaagtgtagggggcaagcattaacatgaaacaggatatcgaaaaagtgctgatctcagaagatgagatccagcagaaagtaaaacagcttggagaacaattaacaagcgagtacagcgacacgtttccgttggcaatcggtgtgttaaagggagcgcttccttttatggctgatcttataaagcatattgatacatatttggaaatggacttcatggatgtatcaagctacggaaattccacggtttcttccggagaagtcaaaatcatcaaagatttggatacatctgtagaaggccgggacatcttaatcattgaagatattatcgacagtgggttaaccttgagctatctcgtagaactcttccgatatcgtaaagcgaaatcaattaagattgttaccctgttggataaaccaagcggaagaaaagcggacattaaagcagacttcgtaggctttgaagttcctgacgcgtttgttgtgggttacggacttgattatgccgagcgctatcgcaatctgccttacatcggagtattaaaaccggcgatttatgaaagctgatcggctgcctgcttccgagatggttatcggttgtattggaatgattttctatggtactattgaacatagttgtgcttactgtgggaggaggtaaggaatgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgataaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacagtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgatcgttccgagggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaattgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacattctgtctaaaacagaagacgaaaagaaagacgagccgaaagaatagttcgctttctgatatgaaaaccgccggcgtataccggcggtttttttactggttccgttttgtttacaaaagagccgcagatcgtgtatggtattgtagaatgttgaaaatgttatgattagaaactattcaaaagtggtgatagaggttgttactggttatagatgtggggaacaccaacaccgtgattggtgtatatcatgatggggaattagaatatcattggcgcatagaaacgagcagacacaaaacagaagacgaattcggcatgctgctccgctccttatttgaacattccggactgatgtttgaacagattgaagggattatcatctcatccgtagtgccgccgattatgttctctttagaaagaatgtgcacaaaatactttcacatcgagccgcaggttgtcggcccgggaatgaaaacaggtttaaatataaaatatgacaatccgaaagaagtgggagctgacaggatcgtcaatgccgttgcggcgatccagcagtatggcggccccttaattgttgttgatttcggaacggcgacgacgtattgctacattgatgaaaacaaacaatacatgggcggtgcgattgctcccggcattacaatttcaacggaagcgctgtactcacgcgcggccaagcttccgagaattgaaatcgcccgaccggacaatatcatcggcaaaaacacggtaagcgccatgcagtccggcatccttttcggctatgtcggacaagttgaaggcattgtaaagcggatgaaatggcaggccaaacaagaaccgaaagtcattgcgacaggggggcttgcgtcattaatcgcaaacgaatcagactgtattgatattgttgacccgtttcttactttaaaagggctggaaatcatttatgagcgaaatcgcgtgggtcacatataggaggtaaacgatggattatttaattaaagcaattgcatatgacggtaaagtgcgggcttatgcagccagaacgacagatatggtaaatgaagcgcaaagaaggcatgacacgtggccgacggcatcagccgcaatcggccggacgatgacagcgtctctgatactcggagcgatgcttaagggtgaagataagctgacagtcaaaatagaaggcggcggcccgatcggagccattgtcgcagatgcgaacgcaaagggtgaggtaagagcatacgtatcaaatccgcacgttcattttgacctcaatgaacaagggaaactggatgtcagacgggcggtcggaactgacggaacactcagtgtcgtaaaagatttgggcttgcgtgattattttacggggcaagtagagattgtctcgggtgaactcggtgatgacttcacgtattaccttgtttcttctgaacaagtcccttcatctgtcggggtaggtgttctagtaaatcctgataacacgattctcgctgcgggcgggttcatcattcagcttcttccggggactgatgaagaaaccatttcaacaattgaaaagcaattatctcaaatcgaaccgatttcaaaattgattcaaaaaggcctgacaccggaagaaatcttagaagaagttctgggtcaaaaaccggacgttctcgaaacaatgccggtcaaatttcactgttcttgttcaaaagatcgattcgaaacggccattttaggactaggcaaaaaagaaatacaagatatgatagaagaagacggaaaagccgaagcggtttgccatttttgtaatgagaaatatttatttacaaaagaagaactggaagagcttcgtgacgaaacaacccgctagctctttagcgggttgttctattttgtaaaagggatggggtagattttgaaatcgagaacacttttgacgattattgtagcggcgctgttggtatgcagtgtagcagtggcgtataagttaacaaaatcccaagccgcggggtcatctgaagaatccatcgcgacaatcggtgataaacatatcacacggcaggactggatgaaaaagatggaagacgagtacggaaaatcaactctggaagacatgattaatgcacaagtagtggaagaacttgcgaaaaagaataaactcacagtttcaaacaccgaattggaacgtgaatttcttttaatcaaagcggtgaataattcattttatgaagacagccatattaccgaaaaagaatggagagaccagatccgctacaacattcttcttgaagaactgctgacgaaggacatcgatatatcggataaggaaatgcaatcattttataataaaaataaagaactgtaccatttcgatgattcctacagaatcaggcacattgtcgtcaaaaacaaggaagaggcggacagggtgcttgctgatttgaaaggcggttccagctttgaagccgtcgccgctgagcgttccacggacagatacacgtctcagtatggcggagacctcggctttgtgacagaaaaccaggaaaatatcccgcaggcatatatcacagaagctaaaaatctcaaagaagatgaatggtccgctgaaccgattaaagtttcttcaggatatgccgtcattcagctgaaagaaaagcttaaagcgagaactttcttatacaatgaagtgaagagccaaatcagacgccagatcgcgatggatcaattaggtgacaaggcgacagtcaaaacgctgtggaaagaggcgggggtctcttggttctacggggaaaaaagaactaaatgattgacaaaaaattttgaaattgataacttatatttataataccaataaatttagtcggaaattgaggtgtccaacatggtgcgtattgcaaattctattactgaactaatcggaaatactcctattgtgaaattgaatcgcctgacggatgaaaacagtgcagatgtatatctgaagcttgaatacatgaatccgggcagcagcgtaaaagaccgtatcggagcggcgatgattgaagcggctgaaaaagaaggaaaattaaaagccggcgacacaatcattgaaccgacaagcggaaatacaggaatcggtcttgcgatggtggcagcggctaaaggtctcagagccattctcgttatgcctgatacaatgagtatggaacgacgcaatctgctgcgcgcatacggagcggagcttgtgctgactcccggcgcagaaggaatgaagggcgccattaaaaaggcggaagaacttgcggaggaacacggatactttgtgcctcagcaattcaacaatgcggcaaacccggaaattcaccgccaaacgacggggaaagaaatcgtagaacagtttggtgacgaccagcttgatgcgttcgtggccggaatcggtaccggcggaaccatcacgggagcgggcgaagtgctgaaagaagcatatccatccatcaaaatctatgcggtagagccggcggattctccagttctttccggcggaaaaccgggtccgcataaaattcagggtatcggggcgggatttgtccctgaaacattgaatacggacatctatgatcaaatcattcccgtcaaaaacgaggatgcatttgaatatgcccgtaaaacggcaaaagaagaagggattctcggcggtatttcttccggagcggccatttacgcggcactggaaatcgcgaaaaaactcgggaaaggcaagaaagtgcttgcgatcatccctagtaacggagaacgttacttaagcacaccgctttatcagtttgaatagagacatacacacggctcccggctgtatccgggagtttttttgtgcctgaagtatcgaaaatccaaaaaacgtttcgaattttatggttggaagtgaaattcacttttttcaccagtgtgattgctttaaaataaaactacagtaaaacgaagcagaggattgatatgatggcacaacgcagaccggcaggaagaaaaataccttttacgaaacaagcatttttacagcgatatgaaaacctttcgaaatcgagaaaacggcatgttctgctcgaaagcgcgagagggggaagattcagtatagccggtctagatccgattgcgtccgtcagagggaaagacggaattacaacgatcaagcatgagggagaaacactgtttaaagaaggtgacccgctgcgggcctttcatgaatggtttggaacgctcggaacggaaacaaacgttgagtttccggactttcagggcggtgcgattggttttatcagttacgactatgcccgatatattgagaattttaagatgctgtcgttagatgatctggaaacacctgatatttactttcttatttttgatgatgtggccgtttatgaccatgaggaagaggcgttatggctcattacccatactgaagcggaagaagcggatcttgcggaagaaaagctgtccggcttagaggacatgtggtgttcccttcaaacggcggacgagcctttttcaccgctgaatcggaatggggacggatcgtacgccgctccgttcaccgaggaaggattttcacaggctgtagaacaaattaaacaatatatcgcgagcggcgatgtgttccaggttaatttgtccatcaggcagtctcagtctttatccgttcatccgtatgaggtgtataaacacttgcgaaacgtcaatccgtctccttacatggcttatctcgagacaccggggtttcaagtgatatgcgggtcgccggagctattggtgacaaagaaggggaagaagcttgaaacgagaccgatcgcgggtacgcgttcaagaggaaaagacgatgctgaagacaaggctttggctgatgaattaattcacaacgaaaaagaacgtgcggaacacgtcatgcttgttgatcttgagcgtaatgacctcggacgcgtatcgcgctacggctccgtgcgggttaacgagtttatggcgatcgaaaaatattcccacgtcatgcatatcgtgtcaaacgtacagggagagctgcaggacggatatgacgcgacagacattattcatgcggtgttcccggggggcaccatcacgggagcgcccaaagtgagaacgatggaaattatagaagagcttgagccgacaagacgggggctttatactggatctataggctggttcggattcaacggagatttgcagtttaacattgtgatccggacgatctatgcagccggcggacatgcatttatgcagtccggagcaggagtggttattgattcggttccgaagcatgaatacaaggaatcgttcaaaaaagcttttgcgatgaaaaaggcgttagagctgagcgaagaagagacaaaaaatcagacgaggtgagcagagatgattttaatgattgacaattatgattcatttacgtacaacttggttcaatatttgggtgagctcggggaggaactgatcgtcagacggaatgacgagattacgattgagcagattgaagagctgggtccggacttcttaatgatttctcccgggccgtgcagtcctgatgaagcggggatcagcctcgaagccatcaaacattttgccggcagtattcctattttcggcgtatgtctcgggcatcagtcgattgcgcaagtattcggcggcgatgtcgtcagagcagagcggctcatgcacggcaaaacgtcagaagttatgcatgacggacagacgatttttaacggcctgcaaaatccgctggtcgccacccggtaccattcacttattgtcaaagcggacacgctgccggattgttttacggtatccgctcaaaccaaagaaggagaaattatggcaatccgccataatgagctgcctgttgaaggtgttcagttccatccggaatccatcatgacctccttcggcaaagagatgctcagaaactttatagagacacaccgcaaaaaggaagtatcggtgtgattatatatttgaatggtcaatatatagaggagaaagaagcggcgctttctccttttgaccatggttatctgtacgggatcggagcgttcgagacgttcaggctttacagcggccggccgtttctgccggatgcgcatgtcgccaggctcaacagggcgcttcgggatctgcagattgcattcgaggtgaacaaacaggagctgcttgatatgcttcggagactgttgcttctcaatgacataaaggacggcagcgcgcgtgtccggcttaacatctcggcaggcgtcagcgataagggatttgccgcgcagacttatgaaaagccgaccgtcctttgtttcgtcaaccggctcaatccggaaactctgcctgttcaaaaagaaggcaggcttctctctgtccggagaaatacgcctgaaggatctttccggttaaaatcccatcactatttaaacaacatgtacgctaaacgggagatcgggaatgatcccaatcttgaagggattttcctgaccggagaaggagatgtcgcggaaggcattgtctccaacgtgttttggcgaaaaggagacaaggtctttacgccatctttggatacgggaattctcgatggggtaacaagacagtttgtcattgatgaattgaaacggcaggggacagaagtcaccgaaggccgattccgttttcaatcaatgcttgaagcagatgaagcatggttgacaaactccgtgcttgaaatcatcccgttttctaaaatagaggaagtgccgctgcccggaatgagcggaaaaacggtgcaattgctccgtaagcagtatcagcaggaaataaacaaaatgaatgtacaggaggaggaacaaaatggcgcagcaaacaattgaacagcctaaactgattcatacaaaaaaaggcgctctgtcctataaagagaagacgctcgttatggggatattaaatgtaacgccagactccttctctgacggcggcaaatacgacagtacggaaagggcgcttctgcatgcggcgaagatggctgaagaaggggcgcatattatagatatcggcggcgaatcgacaaggcccggcgcatcactcgtttcggctgatgaggaaatgtcacgagtcatccccgtcatagaacggattacaagcgagctggacattcctctttcaatcgatacgtacaaagcgtccgtggcagacgaagcggtcaaagcgggagcctctatccttaatgacatctggggggcgaaaggtgaccctgacatggcgtcagtagccgccgcacacggagttccgattatcttaatgcataatcgtatggaaagaaactataacgatcttattcctgatatgcttgcagacttgatggaaagcgtaaaaattgccgcagaagccggcgtcacagatgaaaacatgattctggatccggggatcggctttgcgaaaaactatgaggacaatctggctgtcatgaacaagctggaggtgttcagcgggttagggtatccgctgctcctggcgacatcgagaaaaaggttcatcggccgtgtgcttgaccttccccctgaagaacgtgccgagggaacgggagcgacagtatgccttggcgtccaaaaaggctgcgacattgtgagggtgcacgatgtcaaagagatcgcaagaatgactaagatgatggatgctatgctgaacaaaggaggcgcgcattatggataaagtatatgtggaaggtatggagttttacggatatcacggcgtgttcgaggaagaaaacaaactcggccagcgcttcaaagtagacctgactgctgaactggatttgagcaaagcgggaaaaacggatgacctttcttataccattaactatgcggaattgtacagtgtctgccgcggcatcgttgagggcgagcccgttaatttggtcgagacccttgcggaacggatcgcagacaccgtccttgagaaatttgagccggtgcagcaatgtacggtaaaggttgttaagcctgacccgccgattcccggccattataaatcagtagccatagaaatgacgagaaagaaatcatgaacaatacggcatatatcggcctcggttccaatatgggcgaccgtgaacattatttgcgccaggcagtggccatgctcacccggcatgatggcgtgacggtgtcaaagatatcctctatatatgaaacagatcccgtcggttatgaggatcaggatcagtttctcaatatggcggttgaagtgaaaacgtcgttatctccttttgaactactagatgtaacgcagagcattgaagctgaattaggcagaacgagagagattcgctggggaccgcggacggcagaccttgacattttgctgtataatcgtgaaaatattgaaacagagcggctgattgttccgcatccgagaatgtatgagcgcttatttgtccttgcgccgttaaaagaaatatgtccgcaggcggatcatatcacgataagcgctgaaacaaaccaagaaggtgtaagagtatggaagcagaaatctggggtaggcgaattcgtgcattcagaaagctgaaaggttatactcaagaaggatttgcaaaagcattaggtatatcagtttctattgtcggtgaaattgaacgcggaaaccgattgccgtcagatgccatcattcaagatgcggcagatgttttaaatataagtgcggacgaattggccccgcctgaaaaatagacaaatgaaaggaggggaaaaatgtttaaaatcggtgatattcaattgaaaaaccgggttgtgcttgcccctatggccggtgtctgcaactcagcgttcagattgactgtaaaggaattcggagccggattggtatgcgctgaaatggtcagtgacaaagcgatactttacaacaacgcaagaacaatggggatgctttacattgatgaacgtgaaaaaccgctcagccttcagatttttggaggaaaaaaggaaacccttgtggaagcggcgaagtttgtagatcaaaacacgactgctgatattattgatattaacatgggatgtcccgtaccaaagattacaaaatgtgatgcgggcgccaaatggcttctcgatcctgataagatttatgaaatggtatccgcagtagtagatgctgttgataagccggttacagtgaagatgagaatgggttgggatgaagatcacatttatgcggtgaaaaacgcccaagccgttgaacgtgccggcggaaaagccgttgcccttcacggccgcacaagagtgcaaatgtatgaaggcactgcgaactgggatatcattaaagaagtgaagcaatccgtctccattcccgtcatcggaaacggtgatgtcaaaacgcctcaggacgcgaaacgcatgcttgaggaaacaggagttgacggcgtcatgatcggccgggccgcactcggcaacccgtggatgatttaccgtacggtgcagtaccttgaaaccggtgagttaaaagacgagccgaaagtccgtgaaaaaatgtcggtatgcaaactgcacttagaccgcctgattaagttaaaaggcgaaaatgtggcagtcagagaaatgagaaaacacgctgcctggtatctgaaaggtgtcagaggcaatgcgaatgtacgcaatgaaattaaccaatgtgagacgcgtgaaaaatttgtgcagcttttagatgcatttaccgccgaagcagaggcaaaagagcttcaagatgcaaaagtaggttaatatacaccctctattgctgctcactgccagcttaccgctggcagtttttctgctttttcgtgaaatcaaaatgtaacggagtgataccaatgagtcaagaagagcaaaatcatgaggaattgaacgaccagctgcaagtcagacgagataaaatgaaccagctgagagaaaacggcattgaccctttcggcgaacgtttcgagagaacgcatcaatctcaacaaatcattgaagcctaccaggagctttctaaagaagaactggaagaaaaagcgatcgaagtgaccattgcaggccgtatgatgacaaagcgcggaaaagggaaagccggctttgcgcatctgcaggacttagaaggtcaaattcaaatttacgtaagaaaagacagtgtcggcgaagaacaatatgaaatctttaaatcttcagacctcggagacgttatcggcatcaccgggaaagttttcaaaacaaacgtaggcgagctttctgtcaaagcgacatcttttgaactgctgacaaaagcactgcgtcctcttcctgataaatatcatgggttaaaagatgttgaacagcgttaccgccagcgctatctcgatctcatcgtaaaccctgacagcaaacaaacgtttatcacacgcagcaaaatcatccaagcgatgagaagatacttagatgaccatggatacttagaagttgaaacacctacgatgcacagcataccgggaggagcgtctgcacgcccgttcatcacgcaccataacgcgctagacatgcctctttatatgcgtattgcgattgaactgcacctgaaacgcctgattgtcggcggattggaaaaagtctacgaaatcggccgcgtgttccgtaacgaaggtgtttctacacgccataaccctgaattcacgatgatcgagctgtatgaagcgtacgccgattataaagatattatgagtcttacggaaaacctcgtagcacatattgcgcaggaagtgcttggaagcaccacaatccagtacggcgaagagcagattgatctgaaacctgagtggaaacgactccacatggtagatgcggtcaaagaagcgacaggcgtagatttctggaatgagatgactgttgaagaagcgcgcggtcatgcaaaagagcatggtatcgagatcacaaactctatgacggtgggtcatatcatcaatgaattcttcgaacaaaaaattgaagaaacactcattcagcctacatttatttacggccaccctgtagagatttctcctcttgctaagaaaaatccggaggaccctcgctttacagaccgttttgagctgtttatcgtcggccgtgagcacgctaatgcgtttacggagctgaatgaccctattgaccagagggaacgctttgaagcgcaattaaaagaaagagaagaaggaaacgatgaagcgcatatgatggatgaagacttcgttgaagctcttgaatacggcatgccgccgaccgggggattgggtatcggtatcgaccgccttgtcatgctgttaacaaatgctccgtctatcagagacgttttattattccctcaaatgagacaacgctaataaaagggaaggcgccgtttctgcttatcgcagtacggcgcttttttagaaacaagccgctcgtaaaacttttttgattttcttttaaaaaactattgcactattatttgtgaggtggtatattattattcgttgccgctaaacaaggcgctgacgaaaaaaagaaatttaaaaagttgttgacttcaagagattgataagatataataataaagtcgcttgaacgaaagttataatatgattcctaaaacgaaaaaaacccttgatgtgacaagggttcaagagggttagttacccgtttttcttaaaaaaataacattttaataacatttctttatgaaatcccgagatcgaggatgcttccgaaagtttgctgaactttttgtgaggcatcctctttcattttatttgtaacgtgggtatagattttcattgttgttttcacatcatcgtggccgactcttttcatcacggtcgcaatatcgacacctgcttcagctaacatactgatatgtgagtgtctgaatatgtgaggagtcgcatgtttttttatggatgttttttttagaattctttccatccgatatatgatgctttttggcaggtaagggtacccgttttctcttgcgaaaataaagttttcattatggtactcagataattttgtttgtgattgcaaatgcatctttttcactttcgttttatatgctttcagcatggctataatttgatcgtctatagaaattgtccgaattgatccaggtgttttgggaggagttaattcatactctctcatgttattactttctgaataaatggttttagttatccggagttcttttgtttcgaaattgatgtcagaccatttgagagcacataactccccggatcgcatacctgaaaaagcaagtaaataaaatcgttccagatccatgtgtagaccgtgatttttaactgctaaaagaaattcctcgatctccgatttttcgaggtatttttcagctatgttgttattttcaatttcttcaacggttattctttttttaggcactatagcatctgcaataggattgctcttgagaaactttactttaacagcatacttaaatatcatgcctgctgtcgtatgtactccattcatagtgcttcgtgaatacccttgttctgatagtttgttaagtattttttgatactgtctcaaggttattttattgatgatggatttggcaatgtaggcatttaatatttttatctcttctcgtctgattcggacagtgttctttttcttccctgttaacatatactcttccaaccattcggctgcgacttgatcaaaagttatctttttcactcttgattcatcgatgccatcttcatttaaagctgcaattgcatcacggactctttgctcggcttctttttttgttttgcctcgccgcggaatttgctttcgtttgccggtgactgggtcacgagggccttctccaactgctaaccattttttacccttgattaattctttggtatacattctttcacctcttagattaagtataggagttgttttaaatacaaatgaaattaatgagtagggggaggagagttaatgtattctggaaaagaacttatgttctggtgttttgtttaaagaaaagccctaaaagggctaatcaaaatttaaaaacaggacttttctcaacgactcgatttttactgatgagattccgttcaagtccggatcagtttcagatgagaataagattgaaaacccttgaaccataagggattaggaacatggtgaaattatcctttcggatcgggttcatttgtattccggttcaagttccgatcttattagtaaacagaaataacttaataaacaataaagaataattacttttcctcatttttgtttttgaaattctctgcaatcattttttcaattccatcaagtcgccttagagcatctgcaagatatttatctttttcatcctccgtcatcagttcctgtccttcgacattatcaaaacgaacatcattctgcttacggagttctttagctttatcttggtagtactcttgacctctcagcaagtaatctgtagagacttcaaagaaatcagctattttaactaatgtttcatagtctggctgtctatggcctctttcataattagcatatgtgcccctgtgaacgccaaccttttcagccatttgttcttgtgttaacttcttgcctttacggagttgaattaaccggtctttaaacataatttcacctcattcattaaacattataacgtgtcgaaatgaaacaaataaagttttgtgtcaaaacgacgaaaaagttattgacattgtttctaatggacgatatcataaaaacaaatgattcgtttcgacgcaaatagggggtgaatctattgaggaaatggttgatagacatccgtggagacaaaagccaacaggaaacagctgaggaaattggtatctctagaggtgcttacgcgaacattgaattaggaaagagaaatccttcagtaaaactagcaaagagaattgctaacaactttgatgtcgattggacgcttttttttgaagaaaatgtcgtcgtttcgaaacaaaaatcaaacacagcataggaggtaccaaatatgtttaccatgcaatacgacgataacttcattgatcaaattgcagcaaaaattgctgatagggcaacagatatgttggttgagcggctaggggcgttgaatgagctacctcacatcttaaccagagaagaagcgatgaaagtactcagatgcggtcaaacaaaaatgtctgaactcatgtcgcgacctgatttcccggtaaatgatgagttcggcaagaaaattccaacccagctgctatttaaatggattgaaagaaatacccgttgggtggaggaaaatacccagtatttccgtaagggggcaaccgcatgaatcaacttgtttttattgaaggcgatcaagttgtaaccgatagcctgactgttgctgaggtattcggaaagcgtcatgatcatgttttacgtgatattaaaaaacttgattctagcaaagaatttaatctccacaattttggggaggttgaatataaggacaataggaatcgcacttataaaaaatacctcatcaagcgtgacggtcttacattcttagtttttggttacacaggtgcaaaggcagcgctgtttaaagaaaagtatatttcggagtttaaccgaatggaaaatgagcttcagaaactaaagcagccgtcttatatgattgatgatccagtcagccgagcaaagcgatggatcaccgaacaggaagaacggcaacagcttgaacaaacattgagaattcaggagccgttggtcagttttgctgaatcgtgcatggcgtctgaaaagtccctgcttgtcagagaggttgcaaaacttgcatccaaacaaggcattgttattggtgagaggcagttgtttcagaaattacgagattggaagatgatcttctccaacaaaaatgagccttatcaagaatatgtgaaccgcggttactttgaagtagcacagggagttcgagaagtaagcggaaagtcaaaaacgtggctcacaatgaagattacaccaaagggacaagcctacatcattaacaagttgaaaaagcaacaggcaagttagtattttcattacttaaattttatcagtaaaaaactgaatatatcaggaggcaaacatatggagaacaacccatacaatttgcgaaatttaccgcagattatgcgtggtgtccgaaaatcggcgggccttgcacagtatcaaatcggtaatttaattgggggaaaggatcaacgatatgtttctgatgtggaaaatggctttagcaaactcactcctgaactatgcattaagtggtttgaagtatgtgaagcctatgaacatattgatctcgtgcattatcttttccgtctgcacccaacagcggctgcacccattgatcctgcattaaatgaaagtgcaagtgccgcggtaatcaatatggtccatcagttggaagaggcgttggaagcaacaaaacacctagcccgttggctggcaagtgacaggccgggtaggagggcaggggaactgccaatgggtgatattaaacagattttcgatcttatcccggcaaataagacactcatctattcactagcccgcggacacggtttaaagatacaagaactagcggataggtggacaagaaaagcgctagttgatcaagtagcaatggcaaaacatgaggagaggcaggcaattacgatatgaacaacaatcaatttcttaaatcagatttagaagctgctaaacggaaagtggattcagcagaagaattggcgattatgctaagtgaggccctgcgtgatggtgattacgaggaagccattagcttagccggaagcataaaagttttgacggaggatattaaccggttagcaaacaaaggccgtttgtacgatgtagctatgaaaatgcagcagcgaggtattaatttaactgtaataagcaggtgctcgcaatgaacattgaaaatccaatggttttgaacaactggcacgataaaacgtcagaacctgaaatgaaaaaggatttttttggggacatcataacgccaacagatgattatgtaatcgacagcggcgaggtaattttgagggataatcttgaacggtacttaaaggagcagcttggttttgaatttcaaacagcgcaataaaaaagcccactcggcaaagtggacttcgtaaggcattttgaaatattgattggaacctaattatatcaaaacgcctcatagaaaacaatggaggttttataaatggcaaaatcaattacagtgtcattcagcgaccgggcggacgatcaggagcgtttaagtcaggttggcggttcaattacatttgataagtatggccgtcctgtattcagttttccatcaatggacgcataccgagaatggcagagacgcggcacagaagcttatttgagagaggtggcagcaaaatgaatggattgtctcaggtagattactcagattatatgcctgcacctcaacaggcaaccaacgtgactaccgaagctatggtcagtcgccaagctcaagaggtacaggctgctatggtcattgctaagaaattcccgcgggatgtatacgcggcgttcgatcggattaagaaagcgtgtgaacggagactgttggctgagaacgcggtgtatgaatatccccgaggcggctcaaaagtatccggtccgtctatacgtcttgctgaagcgttggcgcagaactgggggaacattgattacgggattatggaattggaacagaaggcaggagaatcgtctgtcatggcttatgcctgggaccttgaaacgaatacccgtcaaaccaagattttcacggttaagcatgaacggaaagcgcgtggtgctatcacaaagcttgatgatccaagggatatttatgaaatggttgccaatcaaggcgcgcggcggttgcgtgcctgcatacttggagtaattccaggcgatatcgtagatgctgcggttgatatgtgtcagcaaacattaatcagcggccataaagaacctttggaggatcgtctcagaaacgctttatctcttttcaaaaaagagtttggcgttacaaaagaaatgatccaggaatacatcggcaattcgatcgatgctttcactgaacaggatttcttgaagattggacgcatttacacgtcccttcgtgatgggatggcaaagaaagaggattacttcaatatcaaggccacaggcgcgactaagtcaaaggctgaagaagaatttaaaaagcaaaaagagcaagttgggaaggcagatgaaaaaaagaaaaaggctggtgatcctgctgatgaggacgattccggcgctaaacaaggagaattactattctaacgagattgatagatattacatgtcaaattctcaatataagagctttctgcaatgcgaggcggcaacaatggccaagattaacggtgaatgggtgccgccgggttcagaggctctcctcttcggtcaatatgttcatgcctggcttgaagggaaacaggtatttgatgaattcaagagcaacacgccatcactttttacacaaaaaggccagctgtacaagcaatatcagttagctgatctgatgattgaggcgattcaacatgacgaactctgtatgttcgttctgcaaggagcaaaggaagttatcgtaacggctgaacttttcggcgttccgtggaaaggcaagctggacgtatataacccggccggcagtcgttttgcagatctgaaaacaacccgttcacttcgagaaaaggtgtggaatccggaaataggctattgctcgtttgtcgaagcatacggatacatcggacagatggcgctctacgcagaaatggaaaggcgtatgactgggcgtaacgagtggcttgagcctcttatcgtgggggtgtctaaagaggatccgccggataaggcagtcatcaatatcgataagggccgaatggaagtagagcttgaagaaattgagcagcgtatgggtcgtatcctgcaagtgaaatacggcggcgaaaagccggagcggtgtgagagatgcaaatattgccgtgcaacaaatcagttaaacagtatcattcatttctcggagctgatcagctgatggaaaaggatttaattaaggttccgattccgcattgttattactggctagttaagacagtaaggagggatatgaggaagggcttatatacacggtatgtaacggactatctgaagacaaatgaaccatctttagaattaacagatattgattttaaggctctaacagcagtgtgtaaaaggaagtaggtgagcgatatggatacgcaaggattaggatatgtcattttaccccgcctgccatttaaagattcacgggatgagacaatatacgatcatttattcaaacgggcagagtatagaacggatcaggatttagagctaggtcagacaatcattaagcttgtagaattagcaaagcgttttaattggtcatccgatcagattaaatactcgttagacagaatggtcaagcaggagtatttaaaactggacagactgccgcaaaaacgcggctttattgttacagttctgaattacgaggattacatacagcttggcaattacaacaagaagaaggaccttgtccaggtgtcggaagaaagaaaggaagttgatgaaaaagtgaaaaatgtctttgaattattcgagaacaaagtcgcccgtactatcggaccaattgaagctcagcgaattggctatatggttgaagattacggcgaggagaaggtcatggaggctatgaaacaggctttcaggaacaagggcaacaaggttggtttaaattacattgaagcagttctatcaaatccgtttacgcagaagagaaaggagaaaaaacagcatgatagctcacaaaacacaaagtacggacatggcaatggcgggcattctcaaaaaactacgggacaggtcagcccaattttcagcggaacaggccgcctcagaagaaaaggttgaatatgattgtcctgactgcaaggacaaaggaatcattgtttatcggattcaccaagatactgaacgacagctgagaaaagaacaaaaaacaatggagagtcttaacgctgatcaaatggtgagggaagaggattacctagcaggaaaagtgtgcttgccggataaggcccgggaatggaaaaccacattttcaaagcaatgcgagtgtgtaaaacgaaaaaagatcgcgcggcttatgaaggccagcggcattacggaggaatttgaaatgctcttattcggtaattttattacagacggcaagcctgccatgattaaagacgcatatgagtgcgctatggaatactttaaggattttcaaaaagttaaaggagaacgttcgaacagcatcgccctccttgggcagcctggcagcggaaaaacgcacctattaacggcaatcatgaacaaccttattaagaaaaaatctgtttactgcatgtatttcccttacgttgaagggatggggaatttaagagataactttgatcaactagagtccaagcttgatgcaatgagaaaagcggacgttctattcatcgacgatttatttaaaccagtaaagggagaaccgcgggccacagattggcaggttgagcagatccagtcggtcgttaattatcgctacctgaatcacaaacccctgctggtttcatcagaattagatacagcagcattattagatatagacgaagcgctcggatctcggatacatcagatgtgccgtaattatacggtaaccatcaagggagaccgaatgcaattaaatcataggttaggagaatgggaatgagcttaaaaacgaacgttcaaggatccggagggatttatatgttcggccccgctgaacagacaggcggacaggatctcacaccggcgattagggtcctggaggagaaaataaggcaaatggagctggtgagaagtgcttaaagcagttgctgcgctgccagtcatattactgactgcaccttacaaggaaaagcagatcgagcattgggaacagattgacgggaggtaaaaggctgttgagttctattcagtttattgtttacggagagccgatcgcacaaggacggccgcgaggatccattcaaaacggaaaggttagaatgtacgatcctgtaaagtcaaaaaattttaagcagtatgtggcactggttgcgtctcagcatcgaccgaagcaggttattactggtcctgtcgcaatggaagtcagagttttcagaccgatgccgaaaactgtatccggatccaagagaaaaaaggagaacgctgaaaaaggccttttacgccctgtaacaaagccggacgtcgataactatgtaaaaggtgtcaaagacgctttaaaccatttgatatacaaggatgatagtcaggtagtcgatttgaaagtcagcaagttttacagcgaagagccgcgggtggaagtcattataacggagattgtgtcatgacacgccgctttttctatggaccctaaatcaaattatcaggaggtcaacaacatgcaagaaaacaacaataatccttacgtgccaggaccggtgaaggaatggaagatgacgccggaagaactagcagcatatgtcgaaaaacatccaatcatataccgagaggaactaaagccgtccccagcattcacaatgagcggctgggagaacccctactaagggcataaaaaaacaccgaagcttatgcctcagtgcttatgattcgaattggtacttctatcatagcacaggaggagtctaggtgtacaaccccaaagaaattaaaaatcatgaaggaagtattcagcaaagtatggagcctgggaaaatccgtatcatcgttttagatggtactgaaggaacagcgcatgtattggatgtcccagagcacggaaagaccatcatccaaacctcaaaaggcagctttgcgcgagtcgatcacgaaataggattcaaggtgaaataaaacgaatgtaattattcagcaaaggggtttttgaattgatgccattacaagtcaaattacaacgtgtcgtcaaagcaacgaaagatgaagcgatgaccgtcgaacaggcagcagaatatttgaaagttcccaaacaatatataccggtccttgtagcgcgttcagatgatttaaagatgattggtgatgaaacaattattgcaaaacgggataaaactaatatttggctggtcggggcatgcgtggggcttttcttcttcgctgtctctgtcctgccgggaatgttgggatgagggggaataccattgcccggactgcgattataaaaacttgatttaaaaatccgcgcaaagcctgctgtccgcactgtggttgcggcgtgacgctaaagtgaatagaagagcatattagaatgctcttctattcgaaaattaatagacaaatacgtgtaactgaccatatactgagccgtttttgtaaatagttaaatatgcattggcaccagcttttttgccccggacaagtccattggtatctactgtgaaaacagcactattatctgaatgataagcgaatcctgatcctaaatattttgcatctaactgtctagaacccccagctggtacttcaaaagttgcgtaataggatttaattggaccaggagatatagttgtttgtgtttcatttttttgaggagttatctccttagctgaagccataccactaatggaaaaagctaatacaggaatcgatagtgcagtcacagcagtctttttgaaattcattttaaacactcccttttgttttttaatgcaattgtattatcacacttaatacaaaaatatccaagggattttctgttaatattttgtgaacttagtttaaatatatagttctgcccatgcgcatagaccctcgacatgaaagggaactttgctttaatagaggcaattatttctttcaccgcggagtcgttttttcaagatgtgggataagtatataggaaagagggagacaaatgatgttagttataattctagttgtagctctatatttagtatccataccatttgcgtggttaatgacaaagttagggcatcaaatagttcttaaaaacatatcacctaagttaaccgatgtggtgttggtttttctgccatttgcaaatatcactgtaggtctgttttatgcaggtgaaattttaaaatcaaaatctaaaaggaaaataaatcccagaaaattctttaaaatatagaagtaatatatggtgtctagtataataatacctaaaaaggggtttgttatgagctgggcacaattttttactatagctttaactgcaattttatctgcactcttcgcaaatttcgcaacatatctaaaagaaaagaaaatacgcaatgaaaatgcatcagtaaaatacaaggaagaggcattaagcaaaatttatacacctatatataaaatagttacaagagaattgtatacgccaaaaggatatgacggtttaaatcatgaacaaattactcagataaaaggttttgttgataacttccctgaatattgcacagaagaattaatacttttagtaaatgatctttttgatgattcaacaaaattagatggcatggctaaaatgggatattctgaaccatcaaaagtggatgggaataacagactttataattatgcaacagaaaaatttaattcgattagaaaagaattaggaatgataactaaataaatggtccaagacggaaagcctgcggacactgatcattgtacagagaaatctgtgcattggttagtgtccgttttttgtttgcagagggattacatgaagcaggaagagaaagcccgctatgaaagcgaggagcaatctgaacggcttccggcggcagataattgcccaagaggccaaacgagacaagacggtgcatttaaacgagaataaggggaggaatcagaatgcaagatttaatcattgaatacaaacgagctttaagagaaacaagaaaaatatatcggctctacaaagatacagctgaagtcaatctgacggctgaacagatcaacgacaaaaaggttatcagtagcatgatcagtgacatcgaattcgctctcgaatggctgcagaacggaagacagcctggcgcccgccgaggtgctgacagaagagacgcctatcaaagaacgattcttgctgatccgcgtttaattgatgcgctgtcggaagaatacgcaatcgttcaaggggctgagggagagataagtgattgggataaggaaagaatcgctgacgccctttccgtgcttactgagagagaaaaagacatattcatgatgcatgctgtgcaaaacatgtcattcgaagagatagcgcagttattggggattaaaaaaggaactgtgcagaagaacattgaacgttcccgtctgaaaatgaaaaatagagcagatcacagcctattctgtttagcgtgaataggctctttttattggagaaataaagaaaaaagcccatcaaataacttgacgtaagtaaagtattagggtataattaaagtatagaaaggagggaaagaaagtggctgaaatcgcattggtactggggattatcctcacaactctcacagttgttgaaaaagtcctcatcatcagggaaaagcttaaaagaaaaaagcccaaaatcaaaaaacgccgtcgaccaagaaagcgcagatgattttgagccgagggagaaggtagcgcttctcccttgctcctagtataacaaaaataaaaaataaagacattatttgaaagccagccactttcaaaaaaaatgaaaagtgtacagtctactaccgatattgttgttctccttgccctggcgtatatgttgttcttccgtcaggatgtggcagcgggaccgttaaaaacggctctcgatataagtctaatcattttgttcgttgtttcaatcattgaaaaagcattttccctttacttgaaatatcgtgagaaaaaaggatgattcaaaaatgtacaagcctaaagagcgtgatgcaattaagaaattcttgaatgaagagatactcaatacaagcgaagcgcttgagatattagggttcacccgtcagtatctgaatcagttagtaaagaccggcgaattggagccagtgaaagaaatgcctcgggacaggctttttctcaaagaggatattttggattttcaaaagaatagacggaaatgagcatccgaaaaatagggtgctttttttatgcaatgaacaatatttattggaaaaaaatcaatatttttcatataattatattgacggtggtaaatataagtgttataattaaagtatcgaaaggaggtgttaacgagcatggaaatcgttgaatttatccttagggatacagcttggttagtcggaattctcgttgggattacgacactgatcaagaacatcaaagacctaaagggtgataaaaacaaaaaacgacgttctcccgccaagaagaaacgtcgcaaataacccatgaggggaattacttcccctccttgtattataacatcttaatgggtcttaaacaaaaccattaaaattccatgctcggagataatgaaaaaaatattagactcaacaacactgttatttttcatcttgttctgtttacaatttgctcgtatggactttaacaacctgactgtactggacataatatcgatagtgctagcagttatctggctcacgctgacgattataaatgtagttatgaaatggaggaattcaaaggatggataagtttgtatttaatgatgtcgaagaattgagagagttccttgataatgaagtcataaccacctccgaagcgattgaaatcatcggatgcagtcgacaaaatcttaaacagctagttgatcatggaacgctgaagccaatcaaaacaacgaatagggatcgtcttttcttaagaaaagatatagcggcttataaaagaaaacgttaattacatcaaaaataaaatggtgtttttcgtcttacggtagccacctattaataaaggactttcattcgacaaattctgcgaatagttcctttcatgtgctctttacctgataataaggtgggaggtgatgagatgggaaacgaaaatggacgagttaacaatccattagggaatataaagttgccgaaattaaatgttagtttaccgaattaccctacgcctgatttgagtcatattcataagtatagtgaactaatcagtgaggaaaagaaaagggaagttgaagaaaagattcataaggaagaagcggagaagcaatatagagatcaaactcttcaattgctctcgggaattgaaagaaatactgctgtcttgcaagagatttcaaccttaatgagaaaaagtagtgacaaacaagaagaaatcttcgcacttattgtggaaatgttagagataacaaaaagtagtaatcaagaagatgcagtaagtaagtatagaagtatcatggataaaatcaatcaatttacaagtgacagtgcaactttacaatcactttatacactaagtggaacaatttttaatgtggtatctaatatgaatttctagagcatccttcggggtgctttttatattccctgtaaactgatcccggtaaatctcaaggagacaattggcggctaacggattgagtacggtgtcggtttagagggaatgtaaggaggttgcatgatgggattcataacacagtatggagagagcatagaaaaagagacgcaggcatttaagggcataaatatgtcaggggaaaatgaagggatattgagggaatcaatgtatatgaacttcaattctttttggcattcacaccgaaacaaaggaataaggatataagttcatgccgcccaagcccctaaaggaatgtgccgcccgtggttgccgtgcccttactcgggataggtactgtgatgcacacaagacacaacaacaagaagaaacaaaacattacaacaaacattcaagaaacaaaacaataacaagtttttataaatcaactgaatggaaacgaacaagacaacttgctttgatacgagacaattatctctgtcagcattgtttgaaagcacactgcttcactccggctgacatggtgcatcatatagtggaagtaaagcaagattggtcgaaacgattggatataatgaaccttgaaagcttgtgtaatgcctgtcataacaaggctcatggcagtaaaggcaagtgaccacccccctaacaaatctctggaagggaaacgaacggagaacggcgatcccccttctgcaaacaaacaccgcttttcaaagttccgaaaacagcagaaagccccctcggcgaatttgccgagagggcttgatacgactggttttatgattgatttcatcgtatcacgatttatgaaaaaaacaagcaaaaaacgtacttttttgaaaagaaatgaggtgaaaacatgccgagacctgctaaatctgcaacacttcaattaatccaaggtaatcccaacaaaaagaatacggatgagctggctgcccgtgctgagcacgaaaaaaagataaaaatgcgctccgacaatattaaagcgccaccttggttaaataaaattgcgaaaaaagaatttaaaagggttgctgctttgttatctgaggtggagattattactgaagcagatatcagcatgttggccgcctattgtaatgcatactctcagtatatttccatttcagaaatcattgaaaaagatggggttatggtgcataccgagggacaggatgaggatggaaatcctattcagttgattggtgaagagcatccgttattgaagcggcaaaagaattactatgatcaaatgaaatcagctgcgaatgatttcggccttacgccatctgcccgagcaaaactcgcgattacccgaacacaggaggagcgagaaaagacggctgcagaaaaggagtttggtaatgtatgaagacaataaaacaatttcttattgattactcacgcgacgttatatcgggtgagattgtcgcatgtgaaaaacatgtatgggcttgtcagcgttttttaaatgatatcagccgggaaggtaccagagagtttccgtacgtctttgatgatgagaaagcgcgtcgatttctttactggatgacacaattcaagcatacgaaagggccgttgcaaggtgaaaatattgtgccggagcctattcaaatatttattttcggcaatgtgtacgggtgggtgcataaggataacgggtatcgacgctttaaaaaagtgtattggcaggttggccgtaaaaacacaaaaacacaaagcctggcatgtgttggatcctatgaggcaatggctaacgacgaatacatgtccgaggtttacataggtgcaacaaaaacggaacaggcgaaaatctgctggaacgaaattaaagcacagattatgcaaagtgaccttttgaataagccggagaagaaataccgaattgcttacggtaagattgaacatcccaaaacacagtcaaaaatagaggcgctttcgaaagatgcaggtaaaacgggggacgggttcaacccgcaatgcggcatcatcgatgaatatcacgcccataaaacttcagagatttacgatgtactcgcttctggtatggctgctcgtgctcaaccgttaatgatgattattacgacagcagggtttgagctaaataatcccgcctatcgtgtggaatacgattacgtttcacgtatactggatcccaataaagttgagcaaaatgaaaagtattttgtgatgattaatgaattagataaagacgatgacattaaagacgagcgcaattggataaaagcaaaccctattgtggcagctaacgaacacgggctgaattatttgcgtggagaattggaagtagcgcttgctgtgccggagaagatgagaaatttcatgacaaagaatatgaacatttgggttaatatgcgcgagaatggttatatggatatgcaagcttgggcggattgcggttcggatgaatttcctgagctgaagaaccgagaatgttatgtcggcattgacttgtcaaaaacgattgatttaaccgccgcatctttcatcttcccgttagatgacggcagctttgctgtcgatagtcatggatttatgccggaggatacattccatgagcggatgaacacggataaggtcccttatgatgtatgggagaaaaagaactggttaacaacaacagatggtgctgtcgtcgattacgattatatcagagcgtatattaagaaaatggagaaggaacatggctggcgcatcaaggaaattggatacgatccatataacgctactcagttcgctcagcaaatggaggcagacggatatgtaatggttgaaatccgccaaggggtggcaactctctcagagccgaccaaagactttagagcaaaggtcaagtccaaaaaaatcatacacccgaaaaatgatcttctaacttgggcaatggggaacgctgtaacaaaagtggatgctcaagagaacatcatgctggataaatcaaaatcaacccaacggattgacccggccgccgcgcttgtgaatgcgtatgtacgggcttctcaaatcaataatgaggttgatttaaacgcatatatcaagtcagcttcattttctttctaaaggtggtgtagaagtgaagaaaatactgacagccatgatgctttttttaaatgattttctttttatcataggtgctgcttttatattggcagctgcatatcgtttgcacacagacatcggtcttgttttgacaggtgtcttttttatattttatgcactgctgctcagtaagaaaaggaggtgattaattgtttttggaagggctgttttctaagagatcaaatgatgaagagccttggggcctcgcaaatcctcctgattggattatagatatgttcggcggctcaaaaacagctagcggtgaacgtgtcagtgaatcaacggcactcatccatccggatgttttttcgtgtataaatgttttgtctgatgacattgcgaagcttgccgtccatacattcaaaaaaaagcaaggaaatattataagcagtatggatcatcctgttgcccaattgctttatctaaagccgaatcaatacatgacggcttttacttggaaaaaactcatgatgactcatgcttgtacgtgggggaatgcctattcttatataaaaacagatcggaatggctttataacagctctattgccattaaacccagccaatacgcaagcctatgtaaacccaaacacaggtatgctgtggtatgaaacggtcattaattcaaaaagtgttgaattgtatgcagatgaaatcctgcatttcaagggtatgacagaagacgggatcaacggtaagagtcctatcggagttataagggagcatattggcgcgcaatcggctgccacaaaatttaatgcgaaattatataaaaatgatgcgacaccacgggggatcttaaaagttccgactttaatagacgaagatgcaaaacagcgggcgagagatgaatgggaaaaggtaaatgccgggcggaacattgcaattatagatgccggtctttcttatgaatcaatatctatgccattgcaagaagctcagtttgtggagtctatgaaatttaataaggcacaaatcgcatctatttttaaagttccattgcataaaatcaatgagctggaccgggcaacattcaataatattgaacaccaatcgattgaatacgtaaaaaacacgctgcagccgtggctggtttcttttgaacaggaaattattacgaaactctttactgatgaagagattaaagacggattctatatcaaattcaatgtaaacagcgagctgcgcggtgatgcgaaatctagggcggagtattatgaaattatggaacggatcagtgcattaaatataaatgaaattcgtgcttttgaagagaaaaacgcaattgaacacggtgataggcaccttgtatcgcttaactatacattccttgattcattggaggagtatcaaatgaacaaatcaggttccgttaagggaggtgaggacatacatgagcaaggaagttcgccacctaacaacgaagattgagttgcgttctgctggtgaaggagaagagaaaagagattttattgagggttacgccttaaaatttgaaaaatggtctgagcgtttaggtggatggtttaaagaaatcatcagccgggatgcattagcttccacggacctttcaaacgtagtagcgctttttaatcaccgccaggattatccgttagcgagaaacaccgtttctggcgatgctgggcggcttgaattagagacagatgctattggtctaaaattccgttttacccccacagatacgacgtatgctaaagatttaatggagaatatcagaagcggagtcattaatcagtgttccttcgccttttcactgaattataacaagaatgagccggatgaatggcgtcataatgatgaagaagatgtatatgaacgtcgaatcaataacatcgagcgtatttttgacatatcacttgtaacaacacctgcttataacgatacggaggctgtgatcggtgaacgcagtttagaaaaagtcgaacagattaaagaaatgcgcgatgcgccaatagaaaaactaaaaatggaattggaacttttagacctaacgttataggtctattttttatattcaaatctaaggaggatacccgaatgccagtagcaatgacaaaaaaggaacgtgaattaagacaaaaattcacacaaaagaaacaagaggcttcaaatcttttggaggatggaaagcctgaagaagctcgcagcatgcttgaagaagcaaaagagctgcagagtcaaattgaattaatgacagagggccgcagtttagaacttccggagattggcgaggaacgaaactttgctgcagaaatcaaaagtgaaccaaagaaagagacggaagagcgcaatatcttaacagcgacgaaagaataccgggaagcgtggttgaaagtgctcaccggccgcagccatgatcttgaaacagaagaacgaaacatgatggaacgcgttttgaaagaaaaccgttcattatctgcaggcagcgataaagatggcggctatacagtgccggatgatatttcaaaagaaattttgaaatctatccaggaactaaactctgttcgtaatctgatccgtgttgttccgaaaactgcgccatccggaaattatacggttcgtaaaggcgttgccggaaaactttataacacagcggagaaagaacagattaaagaactgaagaatatggaatttgatcaaatttggtataacgtcaagaaattcgccggaatcatgcctgtttccagtgagttgttaaatgattcatttgtgaattttgttcaagagatcgtggactggctgtctgaatcagccgttgtaacagagaatgatgaaattttttatggagacggcggagagaaaaacgttgaaggtatcattagcagcggcaaattcaagtctattaaagcgccgtcactcattacgattaagtttttaaggaaagtgaaaaaccaaattaagcgcggttatcgacgtaacgctgtttgggtgatgaatactgaagcgtttgaaaccctagcaaatatcgaagacaaaaacggccgcggcattttagcggaggatccaagaaatgaggataatttcttgctatttgggcgtccggttgaaatctatgatgaagtcctgacggatgataaaacacagaaaacacacattcttttcggcgactttaaacgcggctatttcatgtttgatcgtcaaaaatttgaaatcaaatctacagatgttggcggagatgcctttcttacagatcagacatatttccgcggtattgagcggttcgacggaaaagtagtggatccagaagctgcaatcattgtaactgatcttgttgttggtgaggatgcaaaagtggaaacacctgaacaatctgctgatcttggaaactaatactgaaaggattgattaaaagatggcaaaactaaacaacattctaaacgaaagtaacggtgtgctaacgtcagcaagagacaacggggaaggagcgcctattacggatatttctgttgctgacaatagcgaagaaaacccactctttgtaaaggggcttaaaggggatccgggtgaacaaggaccgcagggggaacctggtcctgctggtccgaaaggtgaaacaggcgagcaaggtcctaaaggcgaaaaaggtgatccagcagttattgatgagggcagcattgtacatgaaatgctggccgaaaaatcagttcgcagcaaaaatgttgggactggtagtatcatgttggagcacctgaacagtgaagtaaaggctgtacttgatggaatgcaaaaacaaattgatgaactgaaatccaccactcctgcagaatgaaaggcaggtgatgccagatgacagaagctgaaaaaatagaattagaaaaagcgaaaaaattcctccgggttgatggtgacctggaggacgatttaattctcgcgttcattgcctccgcaaaagaatacatcacttcggcaacgggccttgcttttcccaatcaatcagcccgggccgccatgtgcgtaaatgcttttgtggcacattggtatgagaacagggaaatagccggcacaacatctaatttagacggtgtgctgacctcgttaatcaatcagctgaaatatacattgccagggagggcgtcagatgctgaatgatatgcgttaccgcattcaatttcaaaaaaagaagcccggcggccgtctgcctgtggaaggtaatgatagctgggaaacagttattgaatgctgggcaaaggcggagggcttaaagggccgggaatattatgctgcagcggccatacaaaaagaaaaaacagttcaatttacaatccggcaccgggaagatatcaatgaacatatgcgaatcgtctttcagggcgatttatatgaaattgaggctatcttgccgaattattcgcggcggcatttcattacgattaaagcgaatgtggtgagccgatgaactttgaattggaattgaaagggtttagagagcttgaatctactttcgctgatctggcccgtaaggatgaaaagattcataaagcagcagtgaaagccggaggggctgttttggctgcggaaattaatgaggaagctccacgctctgccattggcggaagtcatccgcacattgacgatgatattatagtcggcagccgtatcaggcgggacgaagacggagagatatacgcagttgtaggtcctacaaaagatacaaaattccgtgttcacttgccggaattcggcacgctccatcaggctgccaatccatttattcaccggagtatggtaaaggcgaatggcaaaatgcttgatgcaatggaaaaagtcataaaggcaggctttaaactgtgaatttagtagaaagatcttcacaactaaaaaataaagtatttgaagcgctggaaaaagatccggcgcttttgatgctgactggccctgaaaacatctatgaactagctgtgccagaaggtttggaaagccaacctccttacattgtggttcaagaattagagtacagaacgactgaatgggcagacgggcatccaattaaagatagcactttgtatcaaattgatgtgtatcacaaccagtcttgtgatccaattatggcggctatattggatgttatggggaaactggattttcaaacgacagttcttatcaatgaatttttacaatcagagcgcctcattcgaaaaggttatcggtttgaggcaaacattttattataatcggaggttttaagatgcctgaatacagctcaatggtgggattagaaggcgttcaatacgcaccattaaaaaaagaaaacggcttgtgggttgccagcaagattgtcgactatccacatgcaataaatgcaaagatggcaactgattcatctacagaaaagcaatatgctgataacaaggtagttgaccttgctgtttcaactggttcaacgaaattagacttagagatgagagatgttccgccagaacaccttgtcaatttgtttgggatagaggaaaccacagacggactgtatttatttaaaaagaatgttactccgccttggattgctatgactttctttggtgtgaaagctaatggaaaaagacgatatgtcggcttagtccaaggtcggtttacgctgcctgatgacgactggaatacaaaaaaagaaaaagtggactttcaaacttctaagttgtcagctgaatttcttgaaagagaccaagatgatgtatataaagtgatcgcggatgaagatgctcctaatttcgatttagataagttttatgaaaaagtgtatggcagtgcctatacatcatccactgccgatcaaaaaacaagtacagatctaggtgcttaacttagggattagggaagcttaagagcttccctttgtattcgtatgaaaaggaggagtcaacatggctcaaaaacatatttctattaaactatggttcgaagatgaaaagaaattcaaaacttttattgcaccccggaccaatacaaaaacacttcttgaagcattacgattaaatgcagaagcggaaaaaacagcggataatttggagaaaagcatcaaaatcctcgaaaaacagctgcaatttattgttgggatattccgcaatcaatttacttatgatcaattatttgaggggctggaatcttttgaagttgcgaaagaagtgagccgcattctctcggaagttgccggctataaagaaattgaggctgctgatcaggattttttgccggaacagacggagaagaatacacctacgagcgcggaattgagcaaataaatgaaatttacgctactctcctgcaacaagggtggagtatgaacgcaattgacgagatggacatatatcactatttagagatattgaccgaaaccaataaaccagaagaagtgaaatttgaagatgtcttcttttagacgggcttatagcctgtcttttttgttgaatctttgccaggaaagcggggtggatacatatggctcaacctataggaaatatggtcgttaaggtcggccttgatgatacaggatttaaccgaggaattgagggcttaaaaaggcagatgcgcctggcaaattcagaaatgaaggcagccggaagcatttataaaaatgtcggcaaccaatcaaagctcttgcaatcacagatggagggcttaagcaataagtataagattcaaggcagattagtccaagaacaccgtcaacggtatgaagaactggtcagacagaaaggaaaagacaaccgggagacacagattcaggcgcggcgtttgaatgatgctattgcggttcatgagaatctcggcaaagagctgaataaagtcggcaaagagtttcagaccatgtcagacagcagcagtcgagccgcaggcgttttttctgtttttaaaaaggattcaaaggatgtatcagaagaactgaatgctgtttataaatccgcaacagccacgggaaaggcgttagcgggaattggtgccgccggagcgcttgggatcggtgcaaccgttaaggccgcagcaagcttcgagaaagatatgagccgtgtcgccgcattggcgaatgcaacggacgatcaattggcatcattaacagaaacagctagacatctcggcgctgttacgcaatatacggatgggcaagtagccgaaggcatgcagtatttagcgatggccggctataagacgaaccaaattatcggtgctatgcccggcttgcttgcgacggctgccgccggccaaaccgaccttggcgttacggctgatatcgtttctgacatcttaactgaatttcatattaaggcagaggacacaaaccgtgttgctgatgcaatgacgtatacgttcacgaactctaatgccactttgcaagagattggccaaacgatgaaatacgcggctccggctgctaaaacagcaggtgtcagcatggaagagttggctgcagcaaccggtattatggcaaacagcggaattaaagcagacatggccggaacagcccttcgagcaacgctgacacgtttggcggctccgcctaagccggcggcttccgcaattgaggaattaggtctgaaagtgacggactctactggcaagatgcgcccgctggccgacatcatgggacagatcacagaaaagacaaaaaattatactgaaacagaacaaatccgaatcgccaagcagcttgccggacagaatgctctatcaggttttatcacactcatgcatgcagggaaagataaactgcaagaatttacagcggaaatagaaaacagcggcggcattgctgaaaaagtggctgacacgcagatggacaacctagccggatctgtagaatatctgaaatctgcagcaaataacgcggtcatcaccataggaaatcagtttataccaattatcagggctactactgacggactgacatcattagtgacatggtttgattctttaccacactctgtggcgagcaccatcgctattacaggtggagcagttacggtattttctcttttgggcggggcttttctgttggtacttggagctttaccgaggatcgccgcaggctggaatatgctccgcacggctggaggatatttaaccggtaacgtcaatcgggcatctgcaagtctcggcgtttatacgactgaagctgttgcggcaggtgctgcatcccgaacagcggcagctggtattgcgacaacctccactgcggcaacggtagcagccacccgaatggaaaggctcaaccaaacaaacgccgtggcagcgacgcgagtgggccggctggagcaatcgacaaatagaagctcgaaagcgatgcgcggacttggcggcgcttcccgtgtggccggtactggtctaactcttttcggcggtccaatcggaacaattgccggactcgttcttacttttgctcctgagctgttaaagttcggcgccggaattatcaaaaccggattaaatgccgtaaaaggggccggcggatttatgaagcttgcaaaaagcggtttcggcctgtttaacatacttaaaaaaggcactgctgttgtcggtcttttacgtggcggacttggattgttaggcggaccagtcggcgcgttaattacgggtgtgactcttttagctgatgccggatttaagtattacgacaatttaaagaaacgagtgctcccggcaacaattgattttggagacggtgtatcaaaatccacagcaaaagccgtcaacgcctatgaagacatgaacattgaggttacagccaagctgaacaccctgaaagcgaccaatgctaccatcacgactgatattgcagatgacatgtcaaagcgctttaaagacatgggagattctttgaaaaacggatacaaaaccagcgcgaccaatgcaactaaagtgctgaaagaattttatgcttctaataacggaatgtctgataaagaagaaaataaaatcattggcaaaattgatgcttataacgagaaaaaacaaaagaagatccaaaagtatgttgatcgagtagatgaaatttataagactgccgcccgcgaaaatcgaaaaaccacggaaaaagagaataaagaaatagcaaaaatccaaattgcaatgctctctgaaatggagactgcgctctcacgaagcaaggctgagcagataaagatatctaaaaagttaaaagaagagacgtctaatctttctgctaaacaagcggctgctgttataaaagacagtaacaaggcaaaagagaaaacaattaaagcagctaagaaacaacgtgatgccgttattgatgccgcggatgagcaacgttatgtaaaagggtcaatttctcaagaagaacacgataaaaccgttgaaaacgcaaggagtcaggctaaaaagacaattaaagaagcaaaagaaactcataaaggtgtcgtagaagaggcaaaaaaacaagctgctgggcatattagcgaagttaatacagaaactggagaggtactcggtgtatgggacctatttaaagtagacttggctgagagagttaatgctgttactggctggatcaataatattttagaatttatgcacatggatactatcccagagtggaagcctgctggatacgataaccgtcagccttcctctatgcaaatcgcaccgggggtagcctatgccaagggaacagacttccacccaggcggccgggcattagtcggcgaagaaggatgggagcttgctcacacgcccggcatcggcacttacattgtcggaatgggcggcccgcaagtgtgggatcttccgcgcggcacgtctgttcttccgcacgctcagtcgaaagaagcagctgccacaggacttcccggttatgcaaatggggtcggaaacttcttcaagaatgcgtttgaggggtcgaaaaagctggtgaaaggcgctgtctctgtcggcaagaatgtcattggcaaaacgaaggacgtcgcttctgacgttatggatatgattatcaaagggccgcaaaagataatcagcagcattttcaaaggaatgatcccgtttaaaacaggaaccggaatagacgggttagggactggtattctcaaaacgctaaaaagcggtgcccttcaattcttaaaaggggtcttgccggatgtgggattttttacggcagatgcctataaaggaacaactggatctgcccaggtccaaaaatgggtatcggaagcggtcggcattgctggtgtcccgttttcatgggttcccggcttaatcacgattgccatgaaagagtcaggaggaaatccgaatgccattaaccttacagattccaatgcaagagcaggaaacccgtcaagggggttaatgcagaccattccgagtacgttttcctctaacgcatttccgggtcataacaacatacttaatccggtggacaacattctggcggccattaattacatcaaagggcgatatggagatatatcaaatcatcccggcttgaaatcaatggcgcgcggcggcccgtatgtgggatatgcaaagggcggtacttctccggggcgcggcggctccaagctcgccgtcctcaacgaacgagggtacgatgaaactaccattacgaaagatccagcataccgcgaaaggaatatcggattgtgggcgcgggttgggcgtgagcttggcgtactgccttcactgcaagaagggatgatctcaaaggctttgctattactccaaaaagcatccgcagcacagcctgaaaatgatagaagcgtcaatatcgatatgactcgggtcgtggagaatcaagaaaggcaaatcagcatgatggggcagcagattgacgctctccagcagaacattcagctactgcaacagctggtcttaaaagataacaacacttatattgacggggcccgagtagaccaaacgagcgctgaccgatatagaagaaaacaatatagaaatgggggtaagcctgcttggtaaaactatttttggattttgataacggattgggggagcagagccttgacagcttgctccctcaatttgaagtattgagttttttggcggaagcgccggctatcaatcgggaaacaattacgatcccgcggcgtcatggtgttatctcagcacagcatccacgtgatgtgacctattcatcaagaaaagtcactgtagaagtatatatgaattcaaaaattcacaacaatttctatatacttagacatcagctctatgctttattggtgaagccatttgcctattatatttctactgacttatggccgaatcgtcgtttccttgttatgtgtgatggaaacttcagcattgccaaagaaaaggagaaaacacatgctgttttttcggtcgagtttaccaatattaccgggatggcagaatctaaacattcaaccaaaacagcgcagactcagtcaggagagaactggaacattggtatgaacctgcaatcagatgacaacctggcctattattttaagaatcagaaacgtttctctgtctttaattccggagatgtccaaatcaatccactagatcacgcgtataacgtcctattgaacgccgaagggaagaatgtaacgctaatcaatcataccaatggcgagaaattaacgattgaacaggagttggagaagtcacagcaggtatcatttttaaagcagtacgcgctgctcaataataaaccaataaaaacatctggacgtctgccgaatctcgaaattggatggaatgagtttgaaattcaaaatgccgatgattttgtcatagaatttgatacacggttttactacttgtaaggcaggcggtatatatggcgaatacagattttattaaagagattgccggcgacgcccagcaaatatataaaaagcaccgtattctcgcatcactgatcattgcgcaaggatgcttagaaagcgcttggggcacaagtgaattggcgacaaaagggcataatcttttcggtatgaagggcgaatacaacggccaatatgtcattatgcagacatgggaagttatcaacggagaaaatgtacaagttccggctaaattcaggaaatacccttcatggaaagaatctatacaagacctggcgaacctgtacttaaatggccttagctgggacaaaaaccattataaagctgtcgtcggggaaacagactatcagaaagcaactgcggctctcgtcaaatccgggtatgctaccgacccaaattacgcaacaaaattgaacagcctcattttcacctataaattaacgaaatatgatacaaccgagggagtaccagacgaaccgagtaatccgagtacaccagatcctgagccagacataccaagtaaagaatatgatggtaaagacattacgctgaatcaaaaattgccgaaagacgtttatttccctcaactgcatgtttccagtcaagacggaaatcaagtggtcgaagtcattggtgccgatccggatctgctagatgacaccaccggaaaaaaagatattgagtttacgatcactcgaactgctgataatggcattgaatatgatttgcttataaatgacaatatcctttatctggacgaaaaaaaattcaaccatcaaaaatactttattacgatggttgaggttgatcaggaaaaaacactcagcaagaaagtttctgcaagccatgttttcgtcgccgttttgaataaccattatgtagaagagacgatcagcggtacactgactgtacgaaaaatgcttgatttcacattgaagggaacgaaattctcttatattttcaaagacaaggaaagtgaatttaaaagtgtagagcaggagaattttggtgacaagttcgcgaatgagctgataagcgaaattgtggaagactacggcttagagcttgatgtggataattacaagatttacgtttataaaaagatgggaaagcgtatcaatcacactctcgactctcgttacaatatgcccggcattaaaattaaaacatcgacagacggctgctctacccgagcacggggatacggagcaataaaggaaaacagcagcaccgacagcaaaaaaacggagtacgtctttgagccggtcctttacaagcaccctgacgaaaataagttcctgcttgatggcatgccgcggtgggctgagccactgcgcgacgagcgttataaaaaagagtccagcatgatggaggcgcttaaaaaatacgtgaatccttacccgaaaatggaaatcgaggtggattatgaatacatctatgagccgaagcttcttgaaatacaagatgatttttggaaaggagacactcttcatgtgttggctgatacagtttatggcgtaacctatgaagacgatgtccggctgctttccattcaatataagcccttaaatccatatgcaaaaccaacattgaactttgctaatttccgtaaagatattcaggatatccggatggagcaagaaaagcgattaaaagatcaaaagcgttatgtacaaaaactgagaatgatgatttagaagcgctctttgtaagagtgttttttattttgtcttgaaaggagagtgacacattgggattcaagttaatcaaggattatgacaccactagaaacgcaaggtatattgctgaacaaagagcagatgctgagaccgttgaaaatggattgaatagtcttgaaaacgagataaacagccataaaaagagcaataaagcccactcgtcggagcaaattgaccatggcggcttttctttacgctcatatatcgatggtctatataaccggatacgcaacctgattttaaatgctgatggaacaaatgtaaaagaagttgtggatgcgcgggttgatgctgaaggaaatataactccattgctcaaggagcggctggataaagagtataacaagcttctccaaaagattaaacgaaccgtcaatgtagatgacttcggtgctgatccaaccggagaaaccgatagttcagaagcgtttaaaagggcaattggtactggtaaggttcgcctcatgctatcagccggcacatatgttgttaaaggagtcaaacttccatcttggacatatatgattggtcaaggtatgggtgtcactacacttaagctccatgaagatacaccggccagcgagtgggttgttacaaatgctgatcatacgttaggcaaccggaatattgttgttgaaggtatgtctcttgattggaatccggaacgtcaaggcggtgtaggagcgactggcgggatacattcaagctgcttgacatttgcgcaagtcaagttcggtatcatccgtgaagttgagggtattaatccggggttgcattgcttcgatataactgcaccgacatacgatataactgctaaaaattataccgcaactggcagtaagtatatttggattgaccgctgtgttggctctggttatggtgacgatggcattaccacacactacagcgaatacgttttcattacacataatgttatgacaaatcctaccgggaaggcacatcgtaaaggcggggccaattcaaacggtattgaagtagatgatggttctaagcatatctgggtgattgataactatactgaaggtaacgtccgcggggtagaagttaaggcccatgcagaatggccggcaccttgtaacgtccatattcgaggtcatgaatcctttcgggacgtccgatcatttgatttgcgacacattgggcatcatttagcgacggatccgtggagtgagactgcacgtgatgtgacgttagtagactgcacgtcaagagaaccaaggttcaattcgctttatgaaggactagctccaaaggcgctagttgtttcggcatatcagagagtgaaaatcattggttttacagcgattggggatccgacatacgactacaaaggagattcagttattgcatttcaatataaaagtcgaaagataaacgttaccaatcttcaagtaactggatttaaaactgctgaatatgacattcggattgttggcggcgatcaacgaacagatgatgtcttcatttccgattttgtaagccatgaatcagcacctaacgggatcggaataggaggcggcgtatacaatgtaaatttagttaatggtttactgcacggctcgaatggtatagctggcattacatcgccgaatactcaaacgaacatccttgcagtaagggcttatggctatagaaacgcggcagtattaggtgaccaaaagcactctgtcgttcctaataacgttaaaggcggtttccgcgcagcaacatcttccgggcatccacttacgaattacagtgctatcattgcaaataccggatcaacaattgcaaagggtgaacgaaatctgattgctggtaacgcaggtggagcatctacagaaggatcacgaaatggtgtaatgttttcgtacgattcgcatacgaccggagacggagcttcttcgggtgttatgttttcaaaggctacaaagaatagtaaatcttattcccttgcgatggggcacggtgatggcagcgcatcagaagcgaataaaaagattgaacttaatgctaaaaatgggactgttcgagctacaggcgctattgaaagtgtgtctaatttaaaggacttagcggagtattttgaatctgccgacggctcaaagattgaggcatcttatcttgttgcgttagaaggcgataagattcgtaaagctcatgtaggggacaatattcttggcgttgtttcaaagacagccggcgttgtgctcggtggagcatcgttttattggaatgatcgttatctccgcgatgaatttggcggactggtttatcgtgaggtgaatgatggaaatgaaattcttaagatacctgttgaaaatccgaattataagcctgaagccgaatacaaaccaagagaggaaagggacgagtggcatgtaatcggtttgatcggtcaagtcttcgttaggatcgacgaaacggtaacagtcggcgatagtgtttctgccatccatggtgttgcgacaaaggcggaaagcgccggatacggaactgttatgaaaatcaaaattccgttcgatgtgaaaaaaggttacggggtagcgcagatgctagttacgccgcagcattaagggaggaatcaaagatgtataaaacggggagcgtgtcattcgatattaatgccggacggtcaaacggtcgaaccactaacatacaatttatgacgcaagatacgggcagcgccaagctgtccttttcttttgtgaaggatggcgtaccgttgcctttgtcagcattggatgcaaaaatcgttctgctatatgctgacggatcattttataaaaagagtcttacacttatagataaagtcaatggtacagctgaatacattttgtctgatgaggaactgaagcattacggaactgttaaggctgaaatcaaactatattatacaaacggacaatccctggtaacttcatttttcaccttttctatcgctaaaacgttagaagatcagaacatcattccgacagctgactactacattgacgactttgaaacgctgagagacggggtaaaccaaaccgttaaagaaatcagtcaaaccgttggggaattacgggagaaatttgccgatctcgaagctgttgaaacgaaaaagggctcgcaagaaaaggctgacgctgttcaggcgaatcttgataagcactcaaaggataaaagtaacccacatggagtaacaaaagcgcagatagggctatctgccgtaacaaatgacgtacaagcaaagaaagaggattttgacaaacacacctctgacacttcaaacccgcacaaggttactgcggcacaagttggacttgataaagtcgataatatcaaacaggctgattactatgcttttcgacaacacgataacaacggagaaagacatacatcaaaatttgaaaaggataaatggaatgcaggacagctctttaaattaacggaagataatgggctagcgaagtatctaagcggtgctgatttcaatacggtaacggatacaggcttatactatatgagcagtgtcacgacagcattaaatgcgcccgtgaataataacgggtatctattcgtccacaactacggaacgtatgcatatcaggaatatacgtcctatagcagcagcgactcaacgtcgtcaggccgccgaaagtttatgcgtaataaaatctcaggctcggattcttggacgtcatggcgtgagtttgagtcagtggaaggggcgcagtcaaaagtcgatgttcatgccgataaaacggatattcacgtaacaaaaactgaaaaagacaagtggaatggcggccagatgacgaagttgacaaaggatgacggaaaacgaacacaattagtaaatgagacagacgttctagcgttaagttcaggttattattatgcgaatggcacatcagtcaaaaacaatcctgttgtaaatgatagttcttggttcaactatgatgttatcgaaggcgattccggaagaaagtccatcatagcttggcgtagccatgataacactttgtggcataccacggttcatactaacggtgtttttaaaggatggaaacggctcattacaaataatgattttgaaaatcctgtgtggcaaaatattacgctgaaaaacggtgctaccgtggggacacgcacgccaatatatgcaaaatcgggttctttgttgttattacgaggtcacgtaagggtagatgcagaaattatttttgggtcaataccagttgagtacacgccgataggaggggctgtcgtttcggttgctctaagcggaacagggggaacggcaaatttgattgtatacgatgatggtgacttaaagattaaatatccaacgccacttgattcaaatagattagatggtttttatatagatgtatctgtgccgctacaaacaggaggaactgcaacatgattcaagcatacaagtatggagaagattttatttttatcggaccttctattattagcgaagtagatgagcaaggaaattatattattcctgaaaattgcacgctaattcaaccaccttcattttttaagccgaaattcgatcctagcaagcaagtatgggtagaagcggcaacacgagaagaaaaggatgccatattagagcaggcaaaaagtgtacgagaaccaacagctgttgatattctcaaacaacaaaatgccgccatcatggagcagctggcagaagctcaaagcgcagccgaggaacagtcaaaaatattggctgacttgcttcttatgttagcagagggaggaaaagcatagtggattggttttcaaatataaagactatttatggctggggccgaaactattatacgaatgctaatgtcgcccgttttgttgaattgaacagaattactgaagagcaatataaacaaatcactggtttaacctatcccgctacagaacagccaatcagtgtggatgtgggcgggacagggagctaataaacacccgcagaggtgtttttattttgcctcaagggaggtgatcaacaaatggagggaatacaagtgtggatgaactttgaaagcttacagatcgcaagaacatatcttttcggggaggtgaaataccttgacttacttctcatcctcagtattctggatgtcgtgacaggaattattaaagcatggaagctcaagaagcttcgcagccgtaacgcatggttcgggtacgtccgtaagatgctcagctttttagttgtaattgtggctaatgttattgatacaatcacaaatttgaacggtgttctgactttcgggaccgttcttttttatatcgcaaacgaaggactgtccattacggagaatttggcgcagatcggcgttaaaatcccggccgtcatcactgaccggctacacgtaattgaaagcgacaacgatcagacaaaagaaaaagacgatcaggcggctggttaatccggctgcttttttgtattcaaaaacagaataggagagatttttatgtcagcatacagaaaccaatatattgatattaacaaatggacgcggccgggaatcaaaaacaacggcgtgaagaaactggtggtgcattacacggcaaaccccggcgcgcctgctgccaatcattatagatactttggtcaaacgctccccgtacagaacagaaatctgtctgagaaaaaacagacgtttgcatcggcacatatctttgtcgatcgcacagaggctatttgcatcattccgttgaatgaagtggcttatcacgcgaatgacgtccagcaattcgttaacgggcagccttaccggggtgtcgcggcgctgaaaccgaatgcaaatttcttatctatcggcgtggagctttgcattgaaaagaacggcactttccatccggataccatcgctcgtgcagaacaagtttgtgccgagctgtgcaaaatgtataaactcgatccaatcaatgacattgttcgacattacgatatcacacataaaatctgcccggcgccgtgggtaagcaactctcaagggtttgtcgattttaagacccgtgttaaaaaacgaatggccggtgtggttgtaacggtgcctgcggtatcaaatccggatgttacccatacagatacaggaagattcattaaaaacacggtagtttcaagtgacggtcttgttctacgtacacaacggagcgcctcttcttccatggtgcttaacctgccgaatggcacggttgtaaaatatcagcttggatcaactgtcaacggatggggatatgttgaatacaccaattcaaaaggccagacattccacggatatgtgaatgtctcctatatcaaaagcgataacgagctgaaaagcggcggcaagaagaaagcaacatcgtcaaagcctaaatccactcaaaagtcaaaattcagcttgcctgcgggtacttttaaagtcacaaacccgttaacccgaggggaatctgtaaaacagatccagactgcgttagcgactcttcattattatccagataaaaacgcaaaaaattttggtattgatggtgcgtatggaccgaagacggcaaatgcagtgaaacgtttccagtcaatgtatgggcttcgtcaagacggcatttacggaccagatacaaaggcgaaacttgaagcattattgaagtagcagaaagaatttttgggaggttatatgtagtgattattatgaacatccaactgtttagaggccaatataaatataaaacgaggggataacgagattagcagaggatctaaattagattaagacataaaaaagaggcataagttagaatttttatgcctctttttatattgattagtgtattagctttttctttttcatacccacttaccgtcgattgtaactgtattgtacattgatttcccgatttctaaatcagtgtcacaccagccattcgttactttatggtatttggtgcttccagcatgaatatatcctttaatacttaagcggtatggataagatgatccagaagatgaataaccatcagtgataatcttaccgcctggttttactgtagtaataacgtttgtgccagaaaaaatacgagattggcgatgaaggactttaaatgcaattcctccatgggcagatgttccgtatttcgctatataagcttttgtcaaaaatgaaccagtggcagcacttggtttgacgtaaccttgtcgccaacctgaaggtgaataaaaaccgattgaaactgcaccatttgcttctgtaaacgtcccataaaaaacaaataattcattagaatttactgttccgattttagatccccatgtagttaatccgtaatttgagtagaccggaacgcttgacccttttttgttaatgcaaatagtcataaaaaagctcctctccttattgagtttcttgagtgctactattctatcccgcaatttaaaaatgtaaatgtaaaattaaaattccgtgtattgattatgtatcttatagcttagagaatttggaataaactaaggaaaacgatgaaaagaaagagaaaaataaaagatcattaaataattaatgatctttggattgcaaatagttagctcaatcgtttgtaaggagatatttttcagaaattatattttgaaggtgttttcgaagtttaataattctttggttagcggcttgacgagaaatttgatgttttgctgcatattctgaaacagaaaaagtctctctgtcaagtattacttgaagtgcgtctctatcttgtggaggtgtattctctagaagaattctaacaagttcattggattcaagattgctcagtgaataatcaattgttggcaatatgtcaatcattttaaggtctttgttatttactagggtatctatagataaaatccctttatttttattttttaaagtgtatctagaatacgttacattacgtactccctttttcaatttgtaatgtagatatgttgagaaacacgttccataattgaaatcataaccttcatatgctctccaaagttcaatttctaactcttgagaaaaatcttcctcatcaataaagttaaaaacaaatttattattagtttgttttattgttttttttatcatcggcagaaaatgttttctcgtttcttcaaacgttaattttaaggctcgtccatcagatagtaaaattgttttcaaaccatcaatcctccacaatacagtaactaatctcaacaaataaagaacgtatgttctcattttattctaacataactctaaaaatagcgaaagttgagaactttcggaggtcttgtttgcttacacaagaaataactcagtaccttgctgatggcccttcattactaaagacagaacatgcagtaagaattttagatgaggaatggcttaatttctgacagtgtttataggtcataaaccagacttaagttttgatcgattaaagaccccttcttaatgcaaggagggtttttctgtaattattctctttttatatgactatttcattaaaatttcatttatagtaatataatctagtgaaaaaatatgaaaaggggataaaatatgtctctcgtaagtccggtttttttgtttaattccttaaatacaaaaagaggcggtatgaccaaagcaacaatacatagagcgaatacactcgtttcagagtataaagaaactcaatttctaaccattctttttcaaaagaatcatagaagtatcattcaaaatctttataataccaatgaactggatgaaagagtgaaggtttataatttattcaatgatctagatccttttaagaacagtaaagaagatcatcgtataaaagggaatccgaataaagaagaagaaggcttcatcgtttttaaagcaaacaatgcttttcgttacttcaaagatggtctgtatgtaaagtacaaaaagttcgataacaatggacggcttgcatatattgattacatgaatgaagctagacacaggcttcgcagagaagaatataacgaggatggttatttagtacgtgaacgccaaatggatttgttcagcaacaaaccaaagttagatcgttatttcggaaaggatgggaaatgttatctcacaacatggttaaagcctaaagatgaagagatattccgctgcaatcttttctatcccgagcctttagaatttaagaacctagaagacctggcggcatattggatagctaatcgaacaaaagagattgaatcaccaatcatcatgtctgacaaccctaaaaatttcagtttattattggataaaagattatctgatgtgagaaaagttgttgtgttgcacactaatcattacgatttaaatgagaagggtgaatttgaattaagtcaacaatataatgctttattcaagaaccctgataaatttgatcagattgtgtttttgactgaggaacaaaaaaatgacttttcaaacgagtttggagagcgattgaattatcgcgttattccacatggaataagtaaacctgacactgagaaggataattctaaggttaatccgcacctagcggtaactttgtcccgctatcataaagaaaagggtctagaggaagctataaaggcattcaaaaaagtagttgatgttattccagatgcgaaatacgaaatttatggcgcgggtgagcatgaaacatactttcaagaactaattgaaaaattaaacttaacgaaaaatattgaattaaaaggatttacagacaacaaaattgaggtttatcaaaaagcagcttgttcaatcctcacttcaaaatctgaaggatttggactaaccattcttgaaagcttagccgcaggtacaccggtaacatcatatgatattaaatacggccctaaagatatgatacagaacgagaaaaatggttatctagttaaaacccaaaatgaattggcagacagggtaataaaaatcatgtctgaagaaaagacaagaaaacgtttgtctaagagcacgaagtctatatttaaagggtttggccagaaagtttaccagaaagcatggtttgccttgttgaatgaataaaaaaacagctccttctatcagatgaaggggctgtttgttgtatgagactctttaaggttgatcattgaaaacacatatctttagtttattttattgcaaaggtggttggtatgcttgatcggcaataatgaagtgacttccagatcttacgtatgaattttttgcgaggacggcattgtcatttaagtagggaattttccaaaatatgatcagttggtcaacactttttattttgtcgcctattcgagcagctagatcttcgctatacgtctgcgttattttttttgctctttcgggagtatttttcagattgaatgacaaatgaactaatgctatgtattgcttttctttatttttactcatatcttgattcaattcaattttatcgatagagacgttttttaaattgttttcaactaaatcattgatttgatcttcttctgtttcattttctataacagtagtcgtatcctcatcttcattctgttcatcttctcgcttactaattaagcctgtttcagatataaaatttaattcatcatcgtcaaattccagagtaactgttgatccactttctaacccatctttccctgaataaacgtattctttagaacctgcatataaattgctttctgatctagctttcccgccaactattttcttaacttcctcataagtcatgccttctttaattttatgaaatgtttgtggagttatagctgcttcatgttcatctccaaatttaaaaatgaatctgtttgcaagagacattagaagcaggattgacaaacatccaatcgtaagttgaattccaaattttctagtagactttaaaacaagcagacacaaccctatgaatattccaactatcattagggctgcaaatagtgaataaaataaagacataacttcctcctagatttaaacgatgattccattttaaaggaattgaggatgtttatctatatttttattttgcggagatatgaataaaaaattttcaataaaggagattatttcacgtaaacctattgactgttgtaaataggtttggtataataaaagtatcgaaaggaggtgctaaagtggacgagatcagaaacatagttcttatcatcgctggaatcgtaaccattgtcaaaaatatttatgatatttggcagaaggaaagcgagaagcgagagaagaacagaaaaaagcgctcccgccggacaagcaagaagcgctaaaacatagtaagacaaggggagtaatccccttgctcctacattatatcacgtccacgatgatatgaaaaaatatttaaagcactacaatacattagatatgacgacgttgtttattatattagtgggtattgttgcaattgattttgaaacagctggaacattggggaagattgcagttgtcatcttatatatggctgcgatcgtcaccatactaaaaggttttattctgatttggagagagaacagacatgacagaaaatgaaaagatacagttcattcaaaaagaagtactgactgcagcggaaaccggagaattgctcggtgtcacgaggcagcgtttaagcgctctcgtgagctctgggaaattgaatccggttaagaaagtaggaacagtgagtttatttcttctgagccatgttgaggcacaaaaaaaagaactggaagctggtcggaagaagtatcggccgtatgatgattaattatttatatttcgaaaaaaataacacaaaaataacaaaaatcacattcaaggatgaaaatgcgtgaatgtgtttctgcttagaaagtgctcaaaagcttgaagttaaagggaaataacacgttatgaaagtgtgcggtaagtgaacaacttataagtgtttgactgactacgcacatcgctgtgcgatttatttaaaactttgaattaacaggtacgttttgtctcgtttagttttcaaagaactttgtccatcgctcttgaagcgacttaattattataacatctcagtgtcattgtcgtcaataactttttaaaatttctttttcaagaattcgtttcgtcatcagcgacgtatattagaataccacccttaatccaacatgtcaacaataatcgacaaattaaatgatgaagcgtttaatgactatcaaagccgcgataccgggaatcccaagaattccgctgatgcccgttgtaatcaggttaacagggatatgaatacccagactgcccccgaacaagttcacacccaccaacagaatcgcgccggcaataaacttaatggcagtcacaccaatccaccttaacggttttgaagatactccccataaaaaaagcaaagcaaccagaccgacaatcaaaccgataatgaaaaaaggctccatgaatcttccccctcgcttgtttagtacaagcttatgagaagattccggagaatagacctcttacttccatctgctcattttcaaattccgctgcttcgcttctttcaaataaaaaaagtacttagattcagcgactttcagctcaaacaacacctcagcggagggctctagacttttctcgaccagactcttctgtctgttccattcttctttttgtttaaagagctgttctatcagcttctcgtcaaactcttttcttaatgtatttctgcgaagaaaacccatgccttgccttttcctcccttacaattcacgtcttccttcaagagcttttgaaagagtgacctcatcagcatattccaaatcaccgccgacgggcagaccgtgggcaatacgggagagcttgatgcctgagggctttaacagccttgatatatacatcgctgttgcttccccttcaatgttagggttggttgcgagaataacttctgtcacttgatcatcctgaagacgtttcagcagctccggaatcttaatatcctccggaccgatgccgtccattggtgaaatcgcgccgtgaagaacatgatactggccgttatattccttcattttctccattgcgatcacatccttagggtcctgcacgacacaaataacagacttatctcttcttgtgtcctcacatatataacaagggtcctgatctgtaatatgtccgcaaatcgagcaatatgtcagattccgcttcgcattgacaagcgccttagcaaaatccaatactgtgtcttctttcatacctagaacaaaaaaagccagacgaaccgctgttttcggtccgatccctggcaatttcataaagctgtcaatcagctttgatattggttcaggatactgcatgtttatttatccccctagaataaacccggtatgttcattccttttgtaaattgtcccattgtctcattcgtcatgtcatccacttttttgagggcgtcgtttgtcgcagcaagaaccaggtcctgaagcatttcgatatcttccggatcaacaacttcttctttaatggcaacgtctacaacttctttttggccgttgacttttacagtcaccataccgccgcccgctgtgccttcgagcactttttcagcaagttcctcctgagccttcgccatatccttttgcattttttgcatttgtttcatcattttttgcatgtttcccattccgccacgcatattcaatcactctctttcatcttattagtcttttatttcgattaaatccgctccgacaagttttttcgcctctgcaatcagcggatcttcttcagccggttcgtttgatccttcactttcctgctggtgatcatttaaaaattcttctcttattttaccccattgtgcttccggaacgccaatcaaatccattcttttcccgagcattgattcgagaatctgttcaagattcgtacggactccgttattatcttctgcaaccattttacaatggatttcgtatttaaatttaagcacaaatgccttttgagcagcggccaccggttcactgtcattcaaaagagccgcatgagataccttattctgctgtttcaggtgtgccagcagcttgccccagctgcttttaagctgttcaagatcaggtcttgtggcttccttcaatatctcatgaattcttccgaccggggctttataatgactttttccgcctttttgaggacgcggagcttctttcggagcgctttccatctgaaccttcacaccggaggttttcagcctttctacttcctgctcaagctgctggatcttattcatcagcatgccgacctcagggatgtctccggcggattgctgtgccgtctggcatattttcacgacagccacttcaaaaaagattcttgggtggttcgtccacttcatttcctgatggcttttattcaggatatcaatcatctcatataaagcgggggccggtatgtcaccgctcagattccgaaacgtttcatcgaccttcaccttctccaggactccttctaaaccgggagcggcctggtacaagagcatatccctgaaatagaaaatcatatcttcaatcagtttggccgcatctttcccctgctggagcaattcattcagtgtttccaatgcctcggaaacctgtttgcggtgaagagcagatgccagttttccaatatagtgctgagaaacggctccggtaatgagcaaagcgtcatccaccgacagctcctcgccgctgaatgatacagcttgatcgagcaggctcagcgcgtccctcattcctccgtccgcagcactcgctatgatatcaagggctccttcttccaccttcagctgctctgcatcgacgattgtcttcattcgtccgacaattgctttggatgtaatccgtttgaagtcaaaacgctgacatctggagataatggttaaaggaatcttatgaggctcagtcgtagctaatatgaaaatgcaatgtgccggcggttcttccagcgttttcagaagcgcattaaatgcgccgatagagagcatatgcacctcatctataatatataccttgtaagtaacggccgacggggcaaattttactttgtcacggatgtcgcggatttcgtctacgccgttattcgacgccgcatctatttcaatcacatctgatatagagccatttgtgatccccttgcatgccgcgcactcattgcacggttcttctacaggggcgtgctcacagttgactgctttcgcaaatattttagctgcactggtttttcccgttccccgcggtccagaaaacagatatgcatgagaaaatttcttttgcaaaagggcattttgcagcgttttcgtaatgtgttcctgtccgaccacatcttcaaactgctgaggcctaaatactcgatataaagcttggtaacccacaggatgcgccctcctctgttattcatcatgtttattatacatgaacgtgcttttaacgccaaaacccgtttttcatatacgaaaaaactcacctgccataacaggtgagtctgaaatttgatgattgatttaccgtgcaccttctgtcgattcgctaccctaagcgttacttaagcagttagctcagcccaggcaaccctgcggcacatgagaggtttcacttaatgctgcttccttccggacctgacatggttcatgaattcccattgcgcaggacccagacgtcaacgccacttacttaaggcagaccttacagtaaacgaacctcgagaagggattcggccccgctagagcggattgcgggtacagggcaccgctacctccccgcttagcacggcaaaataaatatcaaattttgatatgcgcaccattcatgatgcacacataagtatatctgcttcaggcagaaaatgcaaccgtactactcagacaactttttcctcatgtctttcttttgccggcgcagctttctgaaaaaagcgctgagcatttctccgcactcttctccgagcacgccgctcaccacttccgcttggtggttgaaccgctcttcctgcaagaggttcatcagcgttcctgtacagccccccttgggatcaaatgcgccgaatacgaccttatcgactctcgaaagcacgacggctcccgcgcacatcggacacggctccaaagtgacatagagaacggcatcctcaagtctccatgtccccagcttacggcacgcttcgtctatcgccagcatttcggcgtgggcaagcgacctctgttcagtctcccgcagattatgcgcccgcgccacgatctcatcgtgcagaacaagaactgctccgatcggcacttcacctttctcttcggctttcttcgcttcttttatggcttctctcatataatattcatcattcatcggtacgagctctcttcttaagttttttcatgtctcataaaggttaaaataggaataccccagcagaaaggagttgccggtattgtctgaacctaacaacacagcccttctgattgtcgatatgatcaacaattttcaatttgatatgggcgaacgtcttgctgaaaaaaccaaacaaattgtcccccgtattttatcattaaagaagcatgcaaaacaaagcaactggccgattatttatattaatgatcattacgggctctggaaggctgatattgatgccatcagggaggaatgcagcaacgacagaagcgcctccattataaaagatatttcgcctcagctggatgattattttctcattaaaccgaagcattccgctttttacgaaacggcgcttcacacccttctgaccgaattacaagtgaaccgattaatcatcacggggattgccgggaacatttgtgtgctgttcacggccaacgacgcttatatgagagaatacagcattgccattccgaaagactgcaccgcttccaataacgacgaagacaatgatttcgctttgaccatgatggagaatgttctcttcgcagaaataaccacggaaaaacaaattaccgccgaaaaataaacatgatcagcctccttttttcatatatttgatagcggatatgaaaggaggcgtttttcattcagatctatatagtgaaacggggcgacacgctttccgctattgcggcgcgctaccggacagccgcaaatgtcattgcggaagcaaataaactgcctaatcccaatacattggttgtcggacaaacccttgtcatcccgattgagggtcaatattacgaagtaaaacaaggtgatactctcgcgtcaatcgccggccgtttccatatatcggccgcggagcttgcgagggtgaacggaattcagcccggcaccacattgagagtcggaacccgcctttacattccgcagcaggcgaataagcccgatatcgaatcaaacgcatatatagaaccgcggggaacgagcgtaagcgctaatcttcagcaggcggcaagggaggcctctccttatttaacatacctcggcgcattcagttttcaagtgcagcggaacgggactttaaaggaaccgcctctgaccaatttaaaaagcatcagtgacaggcacaacaccacactgatgatgatcatcaccaaccttgaaaatgacgcattcagcgatgaactcgggcggctcatcttgaacgacaatacagtgaaaacaaaactctttcaggaaatcgtctccacggctaaaaagtacggctttcgcgatattcactttgatttcgaatatttacgtccacaggacagggaagcctacaatcgttttttacgtgaagcgagaacgatttttcatcgggaaggctggaagatttcaacggcgcttgctccgaaaacgagcgcgactcaggccggcaaatggtacgaagctcatgactatagggcacatggagaaatcgtcgatttcgtcgtgattatgacatatgagtgggggtacagcggaggcccggctcaggccgtatcacctatcggccctgtaagaaatgtcattgagtacgcgctgacggaaatgccttcttcaaaaatcgtcatgggccagaatatgtacggctatgattggacactgcctttcaaacagggaacgacagcgaaagccgtcagtcctcagcaggcaatcgctctggcagcacgctataaagtcgacattcaatatgacgaaaccgcccaggctcccttcttccgatacacggatgcaaatcagagacggcatgaagtatggtttgaagacgcacgatccattcaagcgaaattcaatttaattaaagaacttcatttaagaggaatcagctattggaaactcggcctttctttcccgcaaaactggcttttgctcggcgatcaatttcatattgtaaaagagacgtttcgttaattggaagcgtcttttttcatgggcttttctgtgggtgtgatacaatataaaggccggcagctgacgaatgtttgcagaattaaggaggattttcaatgaacagagccccttttatcgcggtagaaggtcctatcggggcaggaaaaacgacactcgctacgatgctttctgaagagctcggttttcctatgattaatgagattgtggaagacaacccttatctcgataagttttatgacaatatcgaggagtggagtttccagcttgaaatgttttttctatgtcacaggtataaacagcttgaagacaccgatcgagattatttaaaacaaggacagcccgttttgtccgattatcatatttataaaaatgttattttcgcagagcgtacattgcacggccaaaagcttgagaagtataagcagatctatcatctgctcactcacgacctgccgaagccgaatatcattgtatacataaaggcaagcctgccgacattgcttcaacgcattgaaaaacgcgggcgcccgtttgagaaaaatatcgaacatcaatatctggaacatctcattgcagattacgacacagccatcagacagcttcaggaagaagatccggatatatctgtactgaccattgacggtgatactgaagactttgttttgaataagacagactatgaaagaattgcccgtcaggtaaaggagcttattaaatgaaagacattcatattccaaacaacgccattataacagtagcgggaacggtaggagtcggaaaatcgactttgaccaaagctttagcaaaacggctcgggtttcatacctcacttgaggaagtggatgaaaacccttatttagagaagttttatcacgattttgaacgctggagcttccatttgcaaatttattttctggctgagcggttcaaagagcaaaaaaacatgtttgaatcaggcggcggattcgtgcaggaccgttcgatttatgaagatacaggcatattcgcaaaaatgcatgccgataaaggaaccatgtcgctgacagattacacaacatacacaagcctatttgaggcgatggtcatgacgccgtatttcccgcatcctgatgttttgatctacttagaaggcgaccttgaatacattataagccggattgaaaagcggggccgcgagatggagctgcagacaaaccgctcttattgggaagagatgtatacacggtacgaagactggatcagcggttttaacgcctgccctgtactgaaagtacgcattgaagattatgaccttgaagctgatgaacagtcactggaacctttgatcgaaaaaatcagtcacgtgatcagcgaaaacagaaacaaataaaaatagcaaagcgattttccccgaacagagaaaatcgctttttttgcatataaaaaatccgctgcatcagatgcagcggacaaaacaatctccaatatatgctcgagtttcattaggtttaaaatcaatatggcggaggaagagggattcgaacccccgcgggctttgacacccctgtcggttttcaagaccgatcccttcagccagacttgggtattcctccgtatcgacatttaataatataccacatgacccaaatttcagtcaagcgctttttcatattttttatttcatttcttaaacagcttttccgtcagctttactatcatacaaaagtcttgcgtccaattcaacctcagtatgccatacgggcaggaaaacaaagtaaaaatcaagaatagattcaaacagataacctgctcataaaggtggagaacataatgaaaatcatcatcgcacccgattctttcaaagaaagcatgacatcaaaagaagccgctgacagcatagaaaaaggattcaaagcggtcttccctgacgcggaatataccaagatacccgcggccgacggcggagaaggaaccgttcaggctttgacggatgccactggcggaagcatcatcaaaaaaactgtgaccggtccgctgggaacgccggtaaacgccgcatatggacttctgggagacggacgcacggcagtcattgaaatggcggaagcatcgggactccatctcgttccccgccatctcagagatccgttgaacacaacgacaagaggaacgggtgaactgatagcggatgcagcctcccgcggggcgagtgagatcatcatcgggcttggcgggagtgcaaccaatgacggcggaacaggaatggcgagcgcgctcggtgtgcgtttcttaaatgaggaaggtcaggagatacatgacggaggaggcgctctgcacaccctagcttctattgatataagcgggctctcccctgatctgaaacatatccgttttcgtgccgcatgtgatgtcgaaaatcccctgaccggtgaaaacggcgcgtcatatgtcttcggcccgcaaaaaggggcgtccgagaagactaaagttgtattggatcgcaatttataccatttcgctgacgtattgagacgtcagcacgatatcgaagcggataccgtaaaaggcgcgggcgccgcaggggggctgggcgctggactgatcgctttcttacaggcagaaattcaaagcgggattgacgttgtattagatacactgtccttctcagatcagataagagatgctgaccttgtcattaccggagagggccagattgacggacaaacgatattcggcaaaacccccgccgggatcgccgcacgcgcagccgctcaagaaattcccgttatcgcattggcgggctccttaggcaaaaattttgagcatgtttacagcgcaggaataacagctgtattttctatcgtgcccggcgctgtaagtcttgaagacgccttagcatccggccgttttaacctggaaagtacagcccggaatgccgccgctctataccgggcagcaaaaaaggcgcgcctctagggcgcacctttttatggtttgatgacttctttatttcccatataaggacgaagcactttaggaatgatgacacttccgtcttcctgctggtagttttccaagatggcagctacagttctgccgactgcaagacctgaaccgtttaatgtatgcacatgctcaggcttgcctttcgcttcgcgtctgaaacgaatgttcgcacgtcttgcctggaaggcctcaaagttgctgcaagaagaaatttcacggtatgtgtcttggcttggaatccatacctcaatatcgtactttttcgcagctgtaaagccgagatcaccggtacacatgctcatgacgcgatacggcagttcaagcagctgaagcacccgctcagcttgatttgtcagtttttcaagctcctcataagaatcttccggcttcacgaactttacaagctcaaccttgttgaactgatgctgacggatcaaaccgcgtgtatcacggccggcggatcccgcttctgaacggaagcaggcgctgaacgcggcataattgatcggcaggttctcaccggataagatttcatcgcggtgcatatttgtaatcggcacttccgccgtcggaattaagaaataatcctcttctctgattttaaaagcatcctcttcaaatttaggaagctgtcccgtacctgtcatgctcgtacggtttaccatataaggaggaatgacttccgtgtaatcatattcatccacgtgaagatccagcataaagttgtagagcgcgcgttcgaggcgggcgcctaatcctttataaaacacaaaccggctgcctgttacttttgaagcgcgttcgaaatcaagaatgtttaagcggtctgcgatatcccaatgcggtttcggctcatatgaaaatgccggcgcctctccccacttgcgaatttcaatgttatcatcttccgtttctccgacgggaactgaatcgtgcgggatgttcggaatagacagaaggatggtttcgagcgtcgtttcgacagtacgaagctcttcatcaagcttcttaatttcttcgcctacttcacgcatctctttaataatatgatcagcgtcttttttctcccgtttcaaaacggcgacctgctgagacacctcattgcgttttcccttcagttcttctactttaccgataagctctcttctcttttcatccagctcttcaaacttgtcaaagtcagataagtcttcgccttttggaatgagcttcgcttttacctcttgaaaattggctctcagcaccttcgtatcaatcatgcctaacaactcctatctgtttttatcgaaaataaaaaagagccctcatcccctaaaagggacgagagctctcgcgttgccaccctgattgaaaacaagctcacacttgctttccgctttaacacataacggttttcccgtaaatgcctacttgttttcagcatttcgctcaaggacggattcggacagcatctttcaccgattcgcaccacccatcggctctctttgaaagaggggcttcctactgcttcctgtcaacgcttttcgatctttatttgtgattataatgtactataagtatcagcggttttcaactgttttatacagctgtttcctgcttatgcttttccgccatcttcacaaacagctctgtcacccggtgatcatccgtcagttcaggatggaacgagcagccgaggaaatttccctgctttgcagccacgatgcgtccgttatgctcacaaagcacttcaacatcttctccggcttttaaaatatgcggtgcgcgaataaatacacccgtaaacggctcatcaaggcctttaatcgtcagatcagcttcaaagctgtcgacctgacggccaaaggaattacgctcgacaactacgttcaacagccctaaatgagcgttatccgttcccgctatctctttggctaagataatcagaccggcgcatgtgccgaacatcggcttgccttgagcggcaaactcgcgaagcggctccataaaatgatacgtatccattaaacgccgcatcgtcgtgctttccccgcccggcaggattaagccgtcgatgtcattcagctgttcaggacgcttaatgacgacaccttttgaaccacatgcttcaattgaacgaatatgttctcttactgctccttgaagtccaagtacaccaattgttaacatgcttacagctctcctatggttttaccagccgcgttcttgcatacgctgttccggcaatagatttgagatttcgatgcctttcattgctgtgcctaattctttagaaagctcagcgatcagtttgtagtctgtataatgagtcgttgcttcaacaattgctttggcgaatttagcagggttgtctgatttgaaaatacctgaaccgacaaatacgccgtcagcgccaagctgcatcatcaatgccgcgtcagcaggcgtcgctactccgccggcagcaaagttcactacaggcagtttgccgtcacgtttgatctgaagaagcagttcataaggagcgccgaggtttttagcttcagtcatcagctcatcatcgctcatcgcaacaactttgcgcacttgcgcgtttacttttctcatatggcggacagcttccacaatgtttcctgttcccggttcgccttttgtacgaagcatggaagctccttcggcgatacggcgcgttgcttcgccgagatcacggcagccgcatacgaacgggactgtatattcatttttatttaaatgaaattcttcgtcagccggagtcagaacttcactttcatcgatgtaatctactcccattgcttcaaggacacgcgcttcaacgatatgtccgatacgcgcttttgccattacgggaatggatacagcattcattacttcttcaacgattgtcggatcagccatgcgggcaacaccgccggcagcgcgaatatcagccggaacgcgttctaacgccattacggcaacagctcccgcctcttccgcaatcttcgcttgttcagcatttactacgtccatgatgacgccgcctttttgcatttccgccatgccgcgttttacacgatcagtacctgtttgagccattatttggtccccctagtcaatgtatagttagataatgtctatctcttattgtatcccagaaatacaatatttcatatgggtattcttattttacagcgagatgaataagatagatatcatttttttactaataatttggttttttcagtatattaagcaaaagagccctaactttcatcagagctctttcttatttcttaaaaccagcctgttaccgtgtcaacggcgctgttccagataccggagaaaaatccgccgatgccgcgcatcatctgaacaaaccagtttgctttatctacatcatttttcgttacaagattcacgctgaactctttggatttgaggaagccatagtctttgtcactgcctttgtatgtaactgtcagcgttccgactttcgttccctttttcacaggagccgtgatttcttttttatctatagtcacttcggctttatagttcttttcatccccgcttttcacaggaatagaaagcgccttgtcagtaacaatatcgacttgcttgtctttccctttttcaacgtcaaccgttttgtgcccttttacttgagagccttcagggtaaagatctttcattgagaaattgctgttaaatgcgtaatcgagcatttttttcgtttcatcaaaacgtccggtatgcaggttgccttttgcgtttaatacaacggtgatgacccgcattccgttccgctgtgctgtgcttgtaaaacaagatcccgcagaatcagtagaacccgtttttaagccgtcaacgccagggtattcagaaacaagaccttttaacatgaagttccagttcggcatgtccatttcatcatcagtgccggctctgaatttcgttttagcgatgcttgttgttttgagaacttccggataatcagtgatcaggcggtctgcaagaagcgccatgtctttagcagaaacttcactctcttctttaacgccttctccttgcggctgtttgccgtgaagatcttcattcacaagccctgtggcatttttaaaatcatagtttgtcatgcctaattctttggctttcgcattcatttcagcgacaaatttcgtttcagttccggcaagaatttcggcaactgcaatcgcggctccgttagcagagtaaatcgccatggcctgatacagttctttaaccgtgtatttgccgtcttttcgaagggggacgtttgataaactgttgtcttgagaaatttcatagacataatcatcaggagtatacgtttgatcccatttcacttttccttctttaatggcttccagaagcagatattcagtcatcatttttgtcatgctggcaatcggcagtcttttgtctgcatttttactgtataaaatttttcccgatgaagcctcaatcattatcgcagctgatgcgttgacatcaatcgggtcattgccggctgcctccgctttagacatcggaacaaagcaagttgcggccagtgccagtaccactaatgacaccaacagctgtttccatttcgtgatgttcaatcttacgacctccgtcattcattttaaatctataattaagccgttaaggacatattcaaattcaaaacacaacagtataaattttatcacactcgatataaaaaaaatagacagagtcagcgaccctgtcaaatgttttttatttgtaacaattatgagattgtgtagtttggtgattctttcgtaatttggacatcatgcggatgactttcgcgaagaccggcacctgtcatacggatgaattgagcctcttctcttaaagcgcgcaagtcttttgaaccgcaatatcccatacctgaacgaagaccgccgacaagctgatacactgtttcttctacaggacctttgtacggagtccgtccttcgataccttcagggacgaatttcttattttcttcttggaaatatcggtctttactgcctttttccatggcagcaacagaacccataccgcgatacactttaaatcttctgccctgatagatttcagtctctcccgggctttctgaagtaccggcaagcaggcttccgagcattacggcatgtccgcctgaagccaacgctttcgtaatatctccggagaatttaataccgccgtctgcgataattgtcgcgccgtgttttctcgcttcagtggcacaatcataaatggcagtgatctgcggtacgcctacacctgcaacgacgcgtgtcgtacagatagaaccaggcccgattcccactttgacaatatttgctccggcttcaatcaaagcttttgtcgcttcagccgttgcaacatttcctgcgataatgttcagttcaggatatgtttcacggattttcgcaactgtgttcagtacgcctctggaatgtccgtgagccgtatcaaccacgataacgtcgacattcgcttcaacaagcttgctgacgcgtgtcattgtatcgcctgtcacgcctaccgcagcgccgacaataaggcgtccgtgttcatctttagatgaattagggaattcgataaccttttcaatatctttgatcgtgataagaccttttaatttgttttggtcatccactaacggaagtttttcaattttatgtttctgtaagattttttctgcttcgtctaatgtggttcccacaggagccgtaaccagctcttcttttgtcatgacatcactgattttcattgaataatcagagataaagcgaagatcacggtttgtaatgataccgacaagcttttgatcgtctttattatctacgatcggaacaccggaaattctgtatttccccatcaaatgctccgcatcgaatacttgatgatcaggtgttaaaaagaagggatttgtaataacgccccgttcagaacgtttgactttgtcaacatgttcagcctgctgttcgatggacatgtttttatggataatgcccaagccgccctgtctggccatcgcaatcgccattgctgattctgttactgtatccattcccgcactgatgacaggaatattaagctttaacgtttttgtcagttcaacagataaatccacatcacgcggaagtacgtctgattgagccggtacgagcagtacatcatcgaacgttaagccttcttttgaaaatttactttcccacattagtaaatccccctcttttcggcaaaatattatatgtagattatcaactagaaaacagcatgtcaaggaagcgaaaaagagttgaaatatttagataaaggaaagggtttaaaaatacatatgagagatcatgagtggaaagagttatcattattttattccgtagaatcttcccagaaatttctaaacaaagtctatacagaaagcggcatggaagaaccaaaacgatatgcgtttaagaacagtgagcgcttcatattctttatcaaacacgccgagtccttttataagcaggcatctctttctcctttagaaattaagcctattctgttgttttacgggatgtcacaattgctgaaagcctgccttctgaccacagatccaagctatccaagccacgcttcagtactcgcgcatggcgtgactgcccggaaacgcaaaaagcaaaattactcctttagggatgatgaagtgaaggtgcagcgcaatggcttatgtattcatgtaatgaagcacttattcgggatagctggtcttgaggaagaacggtacacaatgaagaaattgctgacagccatacctgaattgcatactgtcttttacttccaagagaaaaagaattggctgacccaagtagagctgaacgatgaccttatttcagtgcctgagcatgcggtgattcattacaatatgtctgattcccgctttgctgaatatatcagccatcatttgaagtggttttttctgaggaaagaccataaccacttggtttttgaggctgacccgatagacagggaaccttggtcttctccaaatttattgtttcacttggagaaaaatcaatattacattccctctcagcgtgatcacttcctgcatcttccggaaatgattattcattatttggttctctacaatatcgggatgattgcgagatatgaaacggagtggtggtatgaactgctgacacagcatgtcagtgatgattatgtgatgatccgacggttcttagaggtcacggaacgcaaatttccgtattacgtttctaatttcctgaagcaatacttgtaaaggagacaaacggtttaccgattatttggcggaagtccgccaggcggcgcttgaggcgtatgaacatcaggactacccgtttgaagagcttgtggagcggctcggcgtgcagcgggacatgagccgtaatccgctgtttgatgtgatgtttattcttcagaatatggagcgggaggagataaatctggccggtctgaaggcgtcacgatcaaagcataccgaacatgatgtatcaagttttgacctgaccttatcagcggctgaatccgatggaaacatccgctttgagatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagctgtttgaagagaaagcagaagaaacgcctcatcagaccgctgttattgaaggagcacaacagatcagctatttacagctcaatgagcgggcaaaccgtcttgcccgaacactgcagaaaaatggattcggtccgggaaaaagagcagccatattagcaaaccgttcgattgaagcgatcgtcagtgttcttgcggtcatgaaatcaggaggggcgtatataccggttgactcccattatcctgaggaacggattcgctatttattaaaagacagcgcggcctccgtcttgatggtgcagtcagaatacaaagaacttgcttcacagctgacggatcacaatttatttctcattcagcttgatcatgaagatcaatacgatatttccgcaaagaatattcagccggcagcgtcaccggctgataccgcatatatcatatatacttcgggaacaacgggaacgccgaagggagtcgaagtcagaaatcgcagctttacgcatgcagcacttgcatggcgcaggatttatgagcttgatcttataccggtcagagcgctgcagatggcgagtttctcatttgatgtattttcaggggatcttgcacgcgccctgctaaacgggggaacgcttgttatttgtccggatgacgtccggcttgagccgcagcagctttatcggctcattgatcagcaccgtatcacgtttatggagtcgacacccgcgctgattgttccgtttatggaatatatataccgccggaaactcgcgctgcaaagcgtaaaaatactggtacttggttcagatatgatcaagtcgcaagatttttatacgcttcatgaacgctttgggaaagaaatgcggatcattaacagctacggtgtaacagaagcgacaattgattcttcgtattatgaagccgaaatgagcgaagagccccgggaagatgatgtgccgatcggtgttccgcttccgaatgtgcaaatgtacgtcttaaacaaagacaaacaggtccagccgatcggcgttttcggagagctgtatatcggaggcgccggcgtcgccaaaggatattggggacagcctgagctgacagaggacgcattcagtgacccgttacaaacgggagaaacgctctacagaaccggagatcaggcttgctggctgccggatggaactcttcgttttaaagggcggatcgataagcaggtgaagatcagaggctacagaattgagacgggagaaatagaaagtgtgcttttgaaacacgatcaagtcaaagaagcggctgttaccgtgatgaaagatgccgaaggacaagcacgattagcggcatacgtcgttcctaaagaggccgatatctcatcactccgccagtctcttatgcaggagctcccggcttatatgatgccgtctcatattatcggtttagacagcatgccccttacactgaacggcaaacttgataaatcggcattgccggcagaagagatacattcatcacaggcatttgtcgcgcccggcgatgaaaaacaggcgatgttatgccggatttgggaagatgtgcttcatattcagaaagcgggaattcatcactctttctttgagcttggaggagattccattaaggcgcttcaagtgtcagcccgactcgccggagaaggctggaacatgtcgatccgcgatttgtttcagttcccgacgattgcagaactcgcgaagcacctcacgccggctgttgcaacggctgatcagggcccgatagaaggaagcgctccgctgacaccgatccagcagagattttttgaggagccgggtgcgtttgagcttcattataaccaatcagtcatgctgtgcagtgaagacagcctcgaaatagatgcgctgtatcaggcggtttgcgcgctgacagaacatcatgatgcgctgcgaatgactttcactgaaaatgagcatggggaagttgttcaatataaccgcggaatcacagagcagcatgaagaaatctttacgcttaacgtcatagatctttcagaagaaacacagccggaaaaacggatagccgctgaggaaaaagaaatacagcaggctatgcgccttgatcaaggccctctgcttcatctcggagtgttcaggctgaaagaagccgaccatctgcttatcacgattcatcaccttatcacggacggcgtgtcatggaggatattgcttgaagatctgcagacagcatatcagcaggcattggacggcaaacaaatcgaactgccgccgaaaagcgattcttatataaagtatgccgaagagctttttgacatttccaagagcaaagcattgctggaggaagcagcatactgggacagcgtgatgtctggtgaaacagcgccgctgccgaaaataactgatgaaaacgccggacgattgcaggaaaacgcgcgcactgcatcatggatattaagcagcgaagtcacgaagcagctgctgatggaaacacagcaggcgtacggaacggatgttcatgaattgcttttaacggcgcttggaatgacgcttcatgagtggacgggttccgaacagatccttatcagcactgaaggacacggacgccaggggcatattcctgacattgatatgtcaagaacggcgggctggtttacatctgtttacccggtgcttttggatatgagagtgccggacggctcaggggaaacaaccgcgcaccgcataaagacggtaaaagacatgatgagacgggttcctcatcacggaaccggctacgggctgctgagatattcgcgaaacattctttataaagacccagaaataagctttaactatctcggtgcgtttgacggtcttgaggggacgctgaagatgtcaccgttcaagccgcagcatgatatagcggccgggcgcatccgcgagtttgatctggatattaatgcgatggtggcggccgggcaactggaggtaaaagccgtttataccgatgtatttgcaccgggggcaatcgagttcttcatgaatcgtttccatactcacctcggggacatcatcgcccactgttccggcaaaaaagagcgggaaaaaacattaacggattacagccatacagaattgaccgctcaagccctatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgtcgagcagatttcgtttacagtcagcggggatttatgcattgatacattccaaaaaagtctggatatgcttgtcagccgttatgatattttcagaacgattttcataaaagaagtgcctgaccttgaagggccgcagcaggttgtcctttcacgccgtgacactgccgtacggactgaagacatttcagactattcggaagaacggcagcaaagcatcattgacgaatttaaggaaaacgaccggcataaggggtttgatctgcaaaaaggccccttaatgcgcctgactctttttcaaacgggagaaaaccgccatacgtgcgtttggactcatcatcacattatgatggacggctggagcttgggccttgtactgaaagatttcttcagcatgtattatgcgatccggagcgggcggcctgtaaacctcggcagtccggctccttacagcacttatatcaaatggctccgaagccggaataaagaagaaacgtcagcattctggtcgcgctgcttggaagattacggagaaaccgtttccgttccgcaaacgaagaataagacggcgcaaaacggttatgcatctgagcatttccaatttttccttgagcctgaaaccgtacaaaaactgacagacattgcccgaggcatcggggtcacgctgaatactatatttacgggcatttggggtctgcttctccatcgttacaacgggactgaagatgccgtcttcggttcggttgtttccggcaggccttcagctatcagcggcattgaatccatggccggactgtttatcaataccgtgccggtaagggtgcgcgcggctagggatatgactttttcttctcttctcaaaaaggtgcaaaaagagtccctcgctgcggaagagcacagctattatccgctttatgacattcaaaacgagagcggcctgcaaaaagatctcttgaatcacatcctggtttttgaaaattatccggttcagatgcaggctgcggtaaacggctggcagcaaacggaaagcagtgcgctctcacttgaaaacttttcgatggcggaggaaaccaattacgatcttaacgtcgtcatcgttccgggagaagagttttatgtaaaattcagctacaatgcgggcatctacgatcgggaagacatgaaacggatcaaagggcatattctggaggtcatctcctgtgtaacggaagatccggacaggcttttatcaagcatcagtctcgtacctccggaggaagaagccctgattcattcgtttaacgaaacgaaccgtccgtaccctgagacaaccgttcatgggctgtttgaagaacaggcggcaaaaacgcctgaccaagaggcgttgagatataacggggtaagctggagctacaagaaattaaatcagcgggcgaatcagattgcccatgcgttaagggaaaaaggcgcccgttcagatcagatcaccgctgttatgctgcgccgatcgatgaatacggtcgccgctctgctcggaatttggaaatcgggcagcgcctatatgccgattgatgcggaatttccgcctgaacggatttcatttttactgagagacagtgaagcctcagtgctcctgactgaaaaagacctgctccccctcattccgccgcatttcaagggcagcgtcgtcatcatggaggaaacggtttcccagcagactgcaccgcttccgccggtgtccggcagcggaaattgggcgtatgtcatttacacctcgggaacgacaggccgtccgaaaggcgtgcttgtacaacacaaagcgatcagcaatacattgcaatggcggcgtgaagaatacggcatgacagaaggcgacatagcgcttcatcttttttcatacgtatttgacggctctttgacaagtcttttcactccgctgctgtccggcgcttgtgtactgttgactgatgaagacgatgcaaaagacgttctttcaatgaaacagaaaatcgcccgccacggggtaagccatcttctgatcgttccgtctctgtatcgcgttctgcttgattcgctgacgaaaaaggatgcgcagacgcttcgggcggtgacatttgccggggaagcggccacccctgatatcgtggaagcgagccgcaacatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcagccggtcggagccgtcggtgaactgtgtatttccggaaaaggtctggcggacggatattttcagcaaaaagagctgacggacaaagtctttacccctcatccgtttcgtgaaggtgaacggctgtacagaacgggagatgcagcccgatttttaccggacggaacgattgaatatatgggacgctttgacgatcaggtgaaggtaagaggttacagaattgaattaggagaaatcgaaacggcactcagaagtctgtccggggtaaaagaggcggcagtcatcgtgcgcaaaacggcggacggggaacaggagcttgcagcttatgccgtgctggaaaacgcgggtgtgacatttgatcctcatgccgaattggccgggagattacctgcttatatgatcccgggaagctttaccaaattgacggaaatgccgctgtctgtgagcggaaagcttgatcgggccgcacttcctgagccgaaagaagccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagcggcgtcgcttgtttcaaagatacataaacggctggaaattgaacttgccgtccgccatgtttttgaacatccgaccatcgagagcatggcccgcttcctagaacagaggaaaagaggagaatatgcagaaatcacgcctgcggaggcaaaggacttgtacccgctatcttttgcgcaaaaaaggctttatgcccttcatcagcttgcggcggacagcacgggctatcatatgcccgcttgtctggaactgagcggcagactcaaccgggatcgtcttcacgaagccttttcagcgctgttacaaaggcatgaagcgttacggacatcatttgttttacgaaacggggagccgatgcagcacgtacattcacatgtcgatctcgatctcacagagattcacatgccatccgggacacttcttcaagaggcgatggaaactttcgtcaaaccgtttgacgtggaaaaagcgccgcttttgagagtgactttagccaaagccactgaagaacgtcattttctgctgcttgatatgcatcatcttatcgcagacggtgtgtcaatgagcgttctgattcaagaattgacggatttgtacagaggaaaagagctgcggccgttaaaacttcagtacaaagatttttccgtctggcagcatgagcggttcgccgctgaagaattcaaaagacatgagcggtattggctggatgcgatcggggaaaatattcccgttcttgatctgccgctcgataaaaagcgcccgcagcttcctgatttcagcgggtccgttgttcgaacgcgcctacaaaaagaaacggcggagaatttgcgccggctcatggatgagacgggttcgacactgtatatgattcttttggcaggctactccttgttcctttctaaattgagcgggcaggaggacattgtcgtcggttcacctgcggccggcagaagccgcgctgagcttgatggggtcatcggcatgtttgtaaataccgtggcaatgagaagcaggccgaaaggggataaaacattccgcgcttatttagaagaggtgaaaatgctcgccctcggcgcagccgaacatcaggacttcccgtttgaagaacttgcccaaaagcttgatacacaccgggaagtcaatcgcaatccgctgtttgatgccatgctcgttttgcaaaacagtgatgatttcaaagtgaaccttccgggcttatccgtttcttcacatgcagtgaaacatgacatttcaaaattcgacttgacgcttcatgccgaggaacagccggacggctcactggattttcattttgaatacagtaccgcgttgtttgaaaaaggtacgatcgaacggtgggccggtcattttaaagagcttttaggacaaatcgcagcggatgatgagcggaagctgtctgacattcatttgctggacacaaatgagcggcagatgcttcttcaagcggaaaatcaaacagctgagtatccgaggcatgagacgatcgtcagtttatttgaagcacaggcggaaaaaatgccggatcaaattgcagccgttatgtccgatgagcgtctcacctaccgcgagctcaatgaaaaggcggatcgaatcgccgatatgctgtcggaaaacggcatccgctccggacagattgtcggaattatgaccgaacgatcccctgatatgctgatcgggattctcggtattttaaaagcgggaggagcttatctgccgattgatcctgactatcctgacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaatgataacgcctgaacagccggcttacgtgatttacacatcgggcacaaccggaaaaccgaaaggcgttatgacggaacaccgcaatgtcatcagccttatcacacataaaggactgccgtttgatttcggctctggagacgtctggaccctgttccactcctattgctttgatttttctgtctgggaaatattcggcgcgctcttatacggcggaaaggtagttatcgtgccgaaagaaacagcccgtgatccgcatttgtaccggcagctgctgcaaagtgaaggcgtaacggtgctgaaccaaacgccgacggctttttccggactcattcatgaagaagccgggcatacggacaagctgaagcttcgatatgtcattttcggcggagaagcgcttcagcccggcatgctgaaaagctggaaagagaagtacccggagacggagcttgttaatatgtacggcattacggaaaccacggttcacgtcacatgcaaaaaactgaagatggatgatattgagagaaataaaagcaatatcggcagaccgctggaaaccctccatgcttttgtcatggacgcctatatgaatccgcagccgatcggaattccaggtgagctttatatcggcggggaaggcgtcgcgaggggatatgtaaacaggaatgatttaaccgcctcccggttcatcacgaatccgcacattaccggcatgcggctctaccggacgggcgatattgccaaaagactctcaaatggcgagctggaatatgtcgggcggaaagatgcgcaagtaaaagtcagaggccacagaattgagctgggagaaataaaatcagcgctgcaggagctttccttcgtgaaagaggccgccgtgatcacacgtgctgatcagcacggtcagcactctatttacgcatacgcggtcttacacgggaatgaaaaaataaaagaagcagagattcaggcctctctcagagcttttctgccggaatatatgattcccgcccgtttgatagagcttgatgaactgcctttgacggcgaatgggaagctggacgagaaggcgctcccgcagcctgaattaaatgaaagccttggagatgatatcagcctgagaaatgaaactgaagaaatgatggctgacatctgggaagaactcttaggtgttgaaggactcggccccaatgctcatttcttccatctcggcggggattcgattaaagcgctgcaagtatgtgcgaggctgaaacagcagggctatgaaacgaccgtccgcgagctgttcgagcatcagacactgggagaagtctcgatgcggctccggaaagtccgccgcgtgattgatcaggctcccgtcacgggagacgtgccgctgacgccgatccagcactggttcttttcgcaatcattgccgcatgatcattttaatcagtccgttatgctaagcagtgcggacagaatcaatgaatctgctatgagaaaagcgctggcacagctcgcggttcatcatgacgcattacggatggtatgcggcacacaaaacggatcagtgattcaatataacagagcggataacctttctgaagaagaactctttacgtttgaaacgcatgacgtgagagggaaagggtcattacaagaggaacacgccgcaattgaacaggcggccgcccgtattcaaacttccattcggctggagacgggtccgctcgtagctgtcggtttatttcacgctaatgatggcgatcatctgctgctttccattcatcaccttgtcattgacggagtgtcatggcggattttatttgaagatctcaccgcgtgctacaggcaggcgctcgaaggaaaagaagccgcgcttccggcgaaaaccgattcctatcagacttatgcaaagcaaatctctgattatgcaaaaagccgccggctgttacaggaagcagactactggtccgaaagagaaaaagcggcggtcaaaccgcttccgaaagatgcccgcatctcttccaatcttctgaaagatacagatgtgatgaccgttacattgacaaaacaggagaccgagcagctgttaacggaagcgaacagagcatacacaacagagacgggcgaattattgcttgccgcgttaagcctagcgctgaacagatggaccggaaacgagacattcaaaatcagcatggaaggccacggaagggaagagcacctggagcatcttgatatcagcagaaccatcggctggtttacgtcaatttatccggtattggttgacgcaagttttcaagatcagcctgatgacggcgagcgtctcggctatcacattaagcggacaaaagacatgatgcgccgcataccgcataaaggagcgggatacggggtgctgaaatatataagcaaactctggggagagactgaatctgattctcctgaaatcagttttaactatctgggacagtttgaccgggaaatccgttccagcggcttcggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacgattgaagttttgacgggatattttcatacctttctcaagcagatcatcacgcattgcacaggcaaagaggagcgtgaatggagcgctgctgatttcagtgacgaggagttaacgctggaagatctgagtgacattatgggagccgtcaacaaactatagaaaaggagtggcgcaatggggcagcagccggaaatacaagatatatatcctttgtcttttatgcaggagggcatgctttttcattctctgttggatcatgactcaagagcctacttcgaacaagcggtgtttacgatcagcggaaagcttgaccgggaacggttccaaaaaagtatagacactgtttttgaacgatacgatattttccgtacgacatttattcacaagaatgtggcaaagccccgacaagtcgtgttgaaaaacaggccgagccgcgttcagtttcatgatatttctcatttggacgagaaggcgcaagacaaatatgccgaccggttcagaaaagaagataaagataaaggctttgatttgcaatcagaccctctcatgagagtctccattttgaaaaaagcgcctgaacgctatgtttgtatatggagccatcatcatattgtcatggatggctggtgcttcggaattgtcatgaaggaatttctgatgatctatcaatctctcggagacggacggcttccgtctctcgagcctgttcagccatatgggaagtatattaaatggctcatgaagcaggatcgtaaagaagccgagattttttggaaaacgagacttgccgatcttgagcaaacggcgtctcttccgaaaaaatccgcggaaccaaacggccaacttgagcaggcggttttcaccatttctgaagaacagacaaatgagctgaagaacattgcggcaagggcgggagcaacgctgaatacagtgttccaggcactgtggggcattttgctgcagcgtgtcagccgctgtgatgatgccgttttcggttctgtcgtttccggccggccgtcggatctcgcaggcgtggaaaaaatggtgggactgtttatcaatacgattcccgtacgggtgaaaagcggttcattttcttttctggagctcgtcaggcatttacagcaggagacgctgcaagcagaagcgtacagctattatccgctgtatgacattcaggcgcaaagccctctgaagcaagcgctgtttgaccatattatcgtgtttgaaaatgtgccggcccagcgtgaaattgaaaatgtgagtcaggccggttcatttgattttgcggtagaggatttcacgatggaagaagtcacaaactacggatgcagcataaaggtgattccaggcaattctctttatatccgcttaaaatttgataccggtatatacgacgatgtttttatgaagaatatcgaaacatttttacggcatatggtgaactcagtcatttccgaccctgaaatcggcgcttccgagatcgcattgctggatgcgtgtgaagccagaagtatgatggatgcctttaaccatacagaagcggctgaaccgcctgctccgacgcttcacgggctgtttacccgccgcgccgcgctttcgccgcatcgtccggcgctccgttttccgggcggtatgctgacgtacgctgagcttgaccagtacacagacaggcttgccgtccggctccgacaaaaaggcgtccgcaaagaaagcatggtcggcgtactcgctgaacgctcgccggagatggcggtttcagtgcttgccgtgttaaaagcgggaggcgcctacgtgccgcttgacccggagtatcctgaggacaggctgcgctatatgcttgaggacagcggcgcttgtctcctgcttgcacagccgggattatccgttcccggtttttccggagaaacgctagaagtgtctctttccgctctgacaggcgagacggagacaggggctgtctctgacgaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatgttatcgtgctgaaatcatccttttcattcgacgcctctatctggcaattgttttggtggacgatatccggcgcctccgtgtatctgcttcctgccggctgggagaaagatcctgtgcggatgattgaagctttttcttctgaaaaggtgacgaccgcgcattttattccggcgatggtcaacagctttttagacgcgctggaaacagagcctgcggaaacaagagtcacgccggtccccgcgatatacagctctccgatacagcccggcggcagaagctgtttcttttgatttaaaatatacagccgcatgttatgtccggaactgccgatcggaacattgtgaaattcctttccttgcggcaaatcgaagtacgccgcttctaccgtcgcttccgtcggaccgtaggaatttgtcaattccgttcccggcagaaggtcataaaaacgggaaaccaagtgcgggcccaattgttcgcccccggcaaaaaccctttttaagcaggtctttttgatcggctgttttctggaatttatatattccaagaaagcatgaagcatggatggcacaaaatgagctgccgtgatgcggtttttctccaatgcgttcagtatcatttcagggtctttctcgccgccttgcggaaggagaaaaacagaagctcccgcgatcggccaccaaaacagctcccaaatcgaagcatcgaaagagtatgatgttttatgcaaaatggtgtcggaatcctttaatccataacgcgcttgcagcgagtataaaaagtttacggctgactgatgttcaacctgcacgccttttgggcgtcccgtagaaccggatgtatagatgatataagccaatgaatcaggctttaccggaacattggggttggccgcagcttccgggtttcctgtttgtccgcttttcagagagatcgtttctccctcaaaaagatctggtgcgaaaagttctggttctgccagtaagaatttcacgccgctgtctttcagtaaaaagcgaatccgctcttccgggtaatccggatcaatcggcagatatgcaccgcctgcttttaagacagcgtaaatgccgatcagcatgtcaggagaacgccggcccataatggcagttttatcctccagccttatcccccgtttgatcagccggtgcgcaagctcattcgctctttcgttcagttcctgatacgtaatcgaaatgtcatcagttaaaatcgccggacggtccggcgttttttccgcctgttgttccagcagctcatgaaggggctgatgaagcggaaacgctgttttctgcaaggggctgaaattttgaagcagagacacttcttctttttctgacaaaacagaaatatcgtctaattccaaacccggatcagctgcggcgttttcggcaagtgtcgtgaaaaattccgcccatttttgaatcgtttttctctcaaacaaatcagtgctgtattcaaactggcagtacaattcaccggcgttttcggagatgtacagcgataagtcaaatttagaaatcggcaggctgacgtctgccggctgcagttcaagtccggctgccttaagcttctgctgttccatattttgcagcgcaaatgttgtgtcaaacagcggatttcgggacatgtcccgcggcacaccgagcttatcgacgagctcttctaacgggtaatcctgatgctcgtaagcctcaagcgctgtttggcgaatttcctttaaatattctttgaacgtcatgcttccgtcgggacacgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgtgctgtatgtttttcgctgatgacaaatgacacccggtcaccggaaaagctccgcaccgggggacgcggcttatcagccggcaattcaagcacgggaatctccccggcaagccggttcagccagtactcctcttgtttccgatatgcggcgcccgccttaaatgattgctgccagaccgcataatctttgtattgaatccgtaacggcggcagacatctctcagcatacagctcactgaattcacgtatcaaaagattgacggatacgccgtctgaaataatatgatgcatgtcagctaaaagcaggtgccggtctttttcaatttggacaaatcccgcccggaaaaggggcgctttgccgagatcgaacggccggataaacgcttcggctgattgttcttttgtaaatgcaaacggcacttcgtcatgaatcctctgcacaggccggccgtttttttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataggtttcttttgtttctgtcttttctatggatgcgaacggattctcttctgcttcaccgatgattttggcgagttcttctacagtcggatagctgaagacatcactcagcgggatttgcacgctgcactctttagctatttttgcaacgagtgccgtcgcctttaatgaatggccgccaagctcgaaaaagtgatcgtgaacgccgatcgggccggtttgaagcacttcttcccatatgcgggtaagcttcagctcggtcacattccggggagctgtatatcgacggcccgctgcgtacgctgaagcttccggaagggcccgctgatcgactttaccgttcgcagtgagcggaatcgcgtcaacgaaagcccatttgaccggaatcatataatcaggcagctctttagccaaatcacttcgcagctgagaaggatcagtcgcttgtgagacgctgcagtaggcgcataattcattttcgcccgactcattcgtttgaatcagcacggcagcttctttcacggcatgatgatttgccagaacggtttcaatttccttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttccgtcagcgccggattgttcacatagcctcttcctgtattcgctccggaaatatacaattctcccgcaattccgagaggctgaagctgtctgtttttgctgagaatatacatcttgttatgatggatcggtttcccgatcggcggatgttcaggtatgtcatctcccgcagaaatcgtatacgttgaaaccacatgggtttctgacgggccgtaatgattatgcagctgcataccgtgtaaacggagcgtctgcctgaacaaacgtgagatagtcagctgctccccggccgtaatgacatgcttcacacagcggggaaaagactgtgcataaccttcttcattgaaaagcatcttgataaacgcagtcgggaaaaacaccacttccgttttgtgctgatcgataaacgaatacagctgagaaacatcccgtttgattgattcgggcacgatacaaagggtgccgccgctcaagagtactgaaaataactcctgatagcagacgtcaaacgccaaagatgcgtactgcagcacatttgtgcaaaaatcaatgcctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgtttgttccgcggggagtgactgatgccgctctgttacaacatggatgcagccgctgttttcaataacatatcggatacgctcctttggactgcccggatctatcggaacaaaggcgccgcccgcttttaaaataccgagaacggccgccgctaaagaaggagaacggccgagcatgacgcctaccggctcctcccgctttaatccgcgtttttgcagcagacgggccagcttattagccgattcattcagctctttgtacgtcactgacccgccttcataccggatcgcgatttgatccggcgtttgtgcggcctgccgttcaaacatcgcatgaatcgtgtcatactcaggcttttcagtctcttcagaaatcggagcaagcagctgctctttttcctcaggagtgatgattacaagcttatccggcgtgatatcaggtttgtcgagaatctgggaaacgatatgtgtcaaatgacctttgatattttcgataaattggcggtcatacacgcttgaatcgtatctcattttcaagtgaatctcgtcacccggcgccaccatcaggtaaaaactgtaattggtttcgtcttccatgctgaaatcatggatgtgaaaaaggtctttcgtgtcccccttgctgttcagtacatcaagctcttgttcaaccggataattctcaaagacgagaatgtggtcaattaagccttgttttacctgcgaattcgcctgtatatcataaagcggatgatagctgtatgcctgtcctttcaaagcgtccttttgcacgtttttgatcagcttttgaaacgggatgtccgccccgctgatccggacaggcacggtattaatgaacaggccgatcattcgctcgatgcctttgatttcagacggccttccggaaataacagaaccaaaaaccgcatcttctgtctggttatacgcctgaagcaaaatgccccagagcgtgtgaaaaatggtgctcagcgtgacctcttctttcacggccagatctttcagcttagctgtgtcctcttttgaaaaggaaaacgtcacttcctcttggctgctttcgccggcttttttctgcttcggcagaacagtctgctgctcaaagccttcaaggtatcgctcccagtacgaagcggctttttctttatcttgctccatcagccacttgatgtaggttccgtacggcacagcgggctcaagcgttaacggtgtccggcggagccgcgaggcgtatatctggaagaactctttcagcacgattccgagacaccagccatccataataatgtgatgaaaactccatatgcacgtatattcacattcaccggtttgaagcagcgtcacccgcatcagcatgtctttttgcaggtgaaatcctttctttcggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaaccttccccgttattgaaaaggaggcctgctcggcgtaagcctgtgattccttttgcaggagggaatgaaaaagcattccttcctgcatataagacagcggataaatatcctgaattgcattcttttttgtcatgttataatctccccgtcgcctttttctacagttcctcaacaaaactcgctatgctgtccaaatcatcagatgttaacgttttgctgctaaaatcactaacggttttttctgcttcctctttgccggtgcagtgcgacataatatcacgcaaatattgctgtaaggtttgcagcagctgttccatcgtttctttgcggaagcggctcggcggatagctcaaactgaagtgcagtttatgttgtgcagccatcgcgctcatttccaccgcttgttcccgctgccatgtcggcgtgatgtcgtgcccgctcgcaagaccggataaactgaatgtgtgctgatcttctgtatcattgaattgccctaaatagttaaagctgatttcaggcgcttgtctgaagcggattgttttttgttcaggcggtgtcatgtattttaaaatgccgtagcctattcctttatccggtattcttccgagtgtgtctttgaccgtttttacagccgttccaagctcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaatatcttgcgtatcggtatggtaggcccggttgacctgctgaagcaaaacggacgtttcttcttctgtaagcgtaaagcttaccgtttgccgaatgctgtcggctcccgtctgatgctgcggtttttcataaggaagtccggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcatgagtgtaagcggcagataaatcctccagcagaatacgccatgacactccgtcaaccgccaggtgatgtacggtgatgaataaataatcccctgaccgggttttgaaccagccggcttttaataacggccctttttcaatatccatccgctgttggagcgcagccacttcatcttctatttctctttcccaagtatctgtctcagacagatcccaaatgtccaagctgtacagttcatctttttgaataccgtgattgatttgtctgatactttcgttttctgaactgacagtgatccggagtgcatcatgatgaatgacaagatgctccaaggcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggccgctgatcgatgactctttccgctttccggataagaggcacgagttccttaatggacggatgccggaataagtcacttgccgtcattttccacccgtagcgtccgagccgtgcggcaacttgcagcgctttgattgaatcgccgcccaactcaaaaaatgagtcctcaatcccgacttgttttgtgccgagcacttcctgccagatcacggaaagctgttcttcaagctcattgcggggagctgtgtacgcggtttgaagcgcgagctccggttcgggcagatttttccgatccaatttaccgttcggcgtaagcggcagcttctcaagttccatcatataggccgggaccatgtaattcggcagttgcttagaaagtgatgaacgcactttttctgtatccatgtccgtctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatctccggtgcggtacatccgttctccgggaacaaaaggattagggacaaatttttcttccgtcagctcagggcggccgaaatatcctcttgccacaccgtctccgcctgtgcataattcgccgatgacgccgatcggctgcggtgttcccctgctgtttatgatatatgcagttgaatttccgacagggcggccgatcgggattgaatgatcgtatgattgttcaatcaaaaagcaagtcgagaacgtcgtgttttcagtcggtccgtatccattccatattgaaagatgcggcagcgttttccgaacccggtttacatgacttggggacagtgcttccccgccgataatcaatcgggataatccggaaaacacgtgttcattttgttctgatagatgattgaacaaagacgatgtcagccacagtgtcgtaatgccgttttgctgtataaatgtttccagaacatcagagtcgagataggtttcctggtcacttacatataaagaagcgccgtttaaaagcggaccgaatatttcaaatgtcgttacatcaaatcctaatgatgaagtaaacaacagtctgtctttcggcgtaaaatcaatataattgctgtttttcacaagacggatcacgcttcgctgttcaatcatgacgccttttggcgcacctgttgacccggatgtataaatcatgtaggccaatgattcaggtccgccgagcggttcgggattttccgagcttaagccggcctttgtttgaatatcctctatgaataaacgttttccggaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctgttgtacgtccggttaataaggcgacaacactttccggaccgacgccatttgatcggagagccgccgctattctattagcccgttcgttcagctcacggtatgtcaagatttgtccatcgtataccactgcccgggcatcgggggtttcttcagcctgccgctcaaataaacggctgatggtttcgtgtcttgggtaatcgcttttcgtctgattaaactgataaatgacgcgatttgtttcagcatcatccaatacgtgaatgtcaccaagcggtattgtttggtcttcaattacttttgtaagaatacgagtaaagtaagaaagccatttttcgattgtctgtttttgatagatatctgtattgaattcaaaatcaaagctgatggaaccgtcagacccttccgccgcgtaaagcgtggcatcaaactttgcggttttatgacctgtatccgcggcttgagtcaaatgcagctcatttaaattcagggattcacgctccatattttggagcacaaacatcacgtcaaacagcggattgcggctcatgtcccgctgcacgccgagccgttccacaagctcttcaaacgggtagtcctgatgctcatacgcctcaagcgccgcctggcggacttccgccaaataatcggtaaaccgtttgtctcctttcggctccgttctgatggcaagcgtgttgacgaacatcccgagaatcggttcaaggtctttgtgcggacgcccggcaatcggcgagccgacgatgatgtcttcctgcccgctcaatcgcgcgagcagcgtattgtacgcggcgagaagcaccatatacaaagaggagccgtgatcccgggcgatgcggtgaaggccggatgccgtgtcagcgtcaagcgtgcacgatacgctgccgcccgcaaagcttctgaccgccggacggggcttgtcagccggaagttcaagcaccggaagctctccttcaagccgcttcagccaataggcttcctgcttctggtaccccaacagctatgctcttactcaaatccatccgaagacatcaggatcggtcgattgtgcacctcttgcgaggccccaacctacgttcactttcattacgcgtacgggttttacacccaaacactcgcatagacgttagactccttggtccgtgtttcaagacgggcggcatataaccattatgccagcatccttgacgtaaagtcgcagtcctcagtcccagctggcagtattcctccaggatataacacttaccgaggcaagctacattcctgaagatttatcctgccgccaaaaccgatgctggcccagtgaactgcgagattcccccacccacaaggagcagagggcgcaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaagcactttacaaagaactgggatcctcgccacacgggattctcaccctctatgacgtcctgttccaaggaacatagacaaggaccagccccaaagttaccttctacaaattacaactcgggcaccaaaggtaccagatttcaaatttgagcttttgccgcttcactcgccgttactaaggcaatcccggttggtttcttttcctccgcttattgatatgcttaagttcagcgggtattcctacctgatttgaggtcaaactttgagagtattgttcgccggattgcgcatgcaatagcctaaacaaacgataaatcgtttacgactaagtctttaaaacgcctaaactaacacgctttctgccgaagttggtaaaacctaatacgacaattcggtattagctagactggacaaaatcatccaagctagcaaaatcacaaccaaataacaggctagcaatttcaagttaaccctgtataagagtatcactcactaccaaacataattgtttgagaaggaaatgacgctcaaacaggcatgccccctggaataccaaggggcgcaatgtgcgttcaaagattcgatgattcacggaattctgcaattcacattacgtatcgcatttcgctgcgttcttcatcgatgcgagaaccaagagatccgttgttgaaagttttaaatatttttaatttcaaacgaaattggttttgactaggttataataataaaaaattgtttgtgtttgtcacctctgggaagaacgtgtgaaacgtaactccccaaagaagaaagtgttgtagaaaacttcacagtgttgtagaagttgaagaagagttaacaacgaaaaaagacatagtctgcaaatggcaagtttcgtcgcgaccgcgcaactaagcgctggctttgaacaaaactgtcttctacagtatcctttatcgtcctctaacttcattcatatagatttctctaatgatccttccgcaggttcacctacggaaaccttgttacgacttttagttcctctaaatgaccaagtttgaccagattctccgctctgagatggagttgcccccttctctaagcagatcctgaggcctcactaagccattcaatcggtactagcgacgggcggtgtgtacaaagggcagggacgtaatcaacgcaagctgatgacttgcgcttactaggaattcctcgttgaagagcaataattacaatgctctatccccagcacgacggagtttcacaagattacccagacctctcggccaaggttagactcgctggctccgtcagtgtagcgcgcgtgcggcccagaacgtctaagggcatcacagacctgttattgcctcaaacttccatcggcttgaaaccgatagtccctctaagaagtggataaccagcaaatgctagcaccactatttagtaggttaaggtctcgttcgttatcgcaattaagcagacaaatcactccaccaactaagaacggccatgcaccaccacccacaaaatcaagaaagagctctcaatctgtcaatccttattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccgagtgggtcagtaaaaaaacaccacccgatccctagtcggcatagtttatggttaagactacgacggtatctgatcatcttcgatcccctaactttcgttcttgattaatgaaaacgtccttggcaaatgctttcgcagtagttagtcttcaataaatccaagaatttcacctctgacaattgaatactgatgcccccgaccgtccctattaatcattacgatggtcctagaaaccaacaaaatagaaccaaacgtcctattctattattccatgctaatatattcgagcaatacgcctgctttgaacactctaattttttcaaagtaaaagtcctggttcgccaagggccacaaggacccaaggttagccagaaggaaaggcccggttggaaaccagtacacgaaaaaatcggaccggccaaccaggcccaaagttcaactacgagctttttaactgcaacaactttaatatacgctattggagctggaattaccgcggctgctggcaccagacttgccctccaattgttcctcgttaaggtatttacattgtactcattccaattacaagacccgaatgggccctgtatcgttatttattgtcactacctccctgtattaggattgggtaatttgcgcgcctgctgccttccttggatgtggtagccgtttctcaggctccctctccggaatcgaacccttattccccgttacccgttgaaaccatggtaggccactatcctaccatcgaaagttgatagggcagaaatttgaatgaaccatcgccagcacaaggccatgcgattcgaaaagttattatgaatcatcaaagagtccgaagacattgattttttatctaataaatacatctcttccaaaaggtcgagattttaagcatgtattagctctagaattaccacagttataccatgtagtaaaggaactatcaaataaacgataactgatttaatgagccattcgcagtttcactgtataaattgcttatacttagacatgcatggcttaatctttgagacaagcatatgactactggcaggatcaaccagataactatcttaaataacgcaagaacgaaaaagattgagtcacagaaaactgcatctcgccctttctcacctcacatcttgaagatacttattgaaaaggttgggatgataaaagttttacccttcatcataccgttagaaactttctgctcacagagttttacccccgttcgcagcgtttccgttccttgccatagcactctttgagttcctctaactgacttccactaaacaccaccccgatgtttcacagatgtaggtttaatatcatcagcttgagaggaggttacactcgaaaaatcacagcccaaaataaatcggaccggctatttaacgaggcattcccccaattcgaattattttgaatagattgctattagctagtaatccaccaaatccttcgctgctcaccaatggaatcgcaagatgtccatgatgagactgttcaggctaagacatctcgaaaagatgtaaaagatacggaaatgcttccatatccttaacgcttctattctcgctgtccatcacccatgtcagaacgctgtatagagactgagcagatctgacgatcactcagagactctctccaccgtttgacgaggccatttttgttcttacgaacgaaaaagcttactcgaatttgtttccaaactctttcaaacttttcttcaaatgctttcgcatgaagttcctcctgaccatgtttaccaaattgtttccatctttaccctatacccatacccattttaatagaaaagcgcattcttttttagcttttgatcctcgggctatcagcactcttgccgagaattgtgttgtctattccgcctcattgggagccggcttcaaaaatcttaagcgaaaaaaaatttaaagaacaaaaaaaattacacggccatatatacatatacataccttgcttaaaaagccgagacaacttgaatatccgtcaatgatgattctacgacaagccgccctgtcttgaagcctcactatcgtcgaggttctacttcctacttgactccggacgtaaagagagaaattctcgaagggccattcagcagaaaacccttctcttccttctcacaaaataaatactgccgaaaaataaaaaatgaaaaaaacccgtctctcaagaacacaatctgcctactacaagacttatacacacatatgttaatcagcgtggagataccagtagacaagagtcaccatcgaggttttaacctttcatggacccagagtcaaacatcagctatcctgtacctaataacgccttaaacgctgggaaaaaaagtttgactataaaattatcttacacccaacttacattgcggctgattgctacttctttacaaggtggttacatttggccaacattttctctgtttacttcgtgagagatattcatctaactttgcaaagcacttggtagtttgataaaaagcttgttcaggtatcaaaacataaacagcgtcaagaagctatgcattgctcatccttcacagcttcacacgtccaacccttcgtgactctctatgcgtctcctttcttctatagtccccacttgcaaagtgcactgacgtttcggaacatgaaccatcacgtgataataacacagtaggtcacatgcactcttcttctcacttccttttaactatgaccacgattccttgcccaactgacttagccaggctcatttacaaagtatttcggttgcggccatatctaccagaaagcaccgtttcccgtccgatcaactgtagttaagctggtaagagcctgaccgagtagtgtagtgggtgaccatacgcgaaactcaggtgctgcaatcttttttttttttttttcctctcctcccgaggctttcagcgatccgcgaccatccgacttaaacactgcgtgaaggcactagaacaagcaagattttattgaatctggaaggtatatataaggctcttagtccaaaacggtgacctcttattcttctcgttcgcattgaacggatttcaaatccttactactctgctcactcaacttctcagcagctacggccagtccacctggccatcgtcttcctttctttttcctgctctcaccttcttcaactgcctcgtataaggatcatatacccctcctaccgtactttcttagaaggattgcctctttggtaccttcacgtacgtagctcttcacgcgtactaaagagcttttcttttttctcttccttcttcttttcatcttcctaccgcatcatgcatgccatagacatatataaatacaaaggacgctacggagaaccaaaaaagatgatcatccctcatttcaagtgctgtctcattcttctatcttagacccccaagggaatggcttcaatagtaacaaccctcattgtgtgttagaaatctgagcaaagcatctcttatcttctctgttaagccttcccatcgtagtctctcttggcccgcctcttcagccccaactatggggaggcgggtttggtaaacttgtcaagaaaaaaaccaacacataaactcttctataaaaaaagctttcttccaccgcgcgcccgagttttcatttcggactttctgaacaatctctgatgtctgaaaaaactcaaaagactcaaaagaatgaaaaatattatatcgtgctcgctcggcctccagagaaaccctacgaccattgtccactacaacctgtacttctaatactctgacgagatactctcgcaataaagagaatcattgcaaagaagaagcactcagatagtttgccgctcatgttatgttgttacccggacctagtctttgcacaaaaaaaattaataaataatacactttcgagatttgtctctgtctttctaaacaaccgccggcgcctgccaacagaatacttaggaagaaataaaacaaatcagacaacaaaggcttaatctcagcagatcgtaacaacaaggctactctactgcttacaataccccgttgtacatctaagtcgtatacaaatgatttatcctcacgcaaaattacattgcaattcgccggcaagcacccaaggcctttccgccaagagtaccattgccagcctgctatggttcagcgacgccataaagacgccttattcgtatccatctatattgtgtgagggaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaaggggacttttacccttttgttctactggagatttctgttctccatgagtcccccttaggacatctgcgttatcgtttaacagatgtgccgccccagccaaactccccacctgacaatgtcttcaacccggatcagctgctaatgcaactttaaaagctagaaggtggaaaatgaattccagttccgcttaattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagttctaagttgatcgttaattgtagcaagcgacgaccaaaaaaggtctaccaaggccgtctacaacaaggcacgcaagcagtccgcctaacagagcaagccccattaagcagtccgcaagcacgcccgctgcgtctgaccaaggccctcactacccgacccttagagccaatccttatcccgaagttacggatctattttgccgacttcccttatctacattattctatcaactagaggctgttcaccttggagacctgctgcggttatcagtacgacctggcatgaaaactattccttcctgtggattttcaagggccgtcgtaagcgcaccggagccagcaaagatgctggcctcttccagccataaaaccccatctccggataaaccaattccggggtgataagctgttaagaagaaaagataactcctcccagggctcacgccgacgtctccacattcagttacgttaccgtgaagaatccatatccaggttccggaatattaaccggattccctttcgatggtggtctggaaaatcagacctttgaaacggagcttccccatctcttaggatcgactaacccacgtccaactgctgttgacgtggaacctttccccacttcagtcttcaaagttctcatttgaatatttgctactaccaccaagatctgcactagaggccgttcgacccggccttacggcctgggcttcgtcactgacctctacgcctgcctactcgtcagagcataattattaaccctgacggtggagtataggtaacacgcttgagcgccatccattttcagggctagttcattcggccggtgagttgttacacactccttagcggattccgacttccatggccaccgtccggctgtctagatgaactaacaccttttgtggtgtctgatgagcgtgtattccggcaccttaactccacgttcggttcatcccgcatcgccagttctgcttaccaaaaatggcccactaaaagctcttcattcaaatgtccacgttcaattaagtaacaaggacttcttacatatttaaagtttgagaataggttaaggtcatttcaaccccagtacctctaatcattcgctttacctcataaaactgatacgagcttctgctatcctgagggaaacttcggcaggaaccagctactagatggttcgattagtctttcgcccctatacccaaattcgacgatcgatttgcacgtcagaaccgctacgagcctccaccagagtttcctctggcttcaccctattcaggcatagttcaccatctttcgggttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacgatccggttgagcctgttggacctgttactccggttgcacccgttactcctgttactccagttgctccagttaccccggtggctcccgttactccggtagcgcctgttatcccagttgctccagttactccagttgctccagtcacacccgttggaccggttgggcctgttactccggtcgatccggttgatccagtcacaccggttactccagttgagcccgttgctccggtttctcctgttggtccagtcacaccggttgggcccgtcgcgcctgttgctccggttatccccgttgctccagtcactccagttgcaccggtttctcccgttgtcccagttactccggttgatcccgtggttccggtttctcctgttactccagttggacccgtttctccggttgaacctgttactcctgttgcgccagtcgctccggttatccccgttgccccagtcactccagtggctcctgttgatcccgttactcctgttggtccagtcacaccggttggtccagtcacacccgttgaaccggtttctcctgttgagccagtaacccctgttgatccagtcacaccggtttctccagttgagcccgttgctccggtttctcctgttggtccagtcacaccggttgatcccgtggttccggtttctcctgttacacctgttgggccggtttctccggttgaccctgttacaccggtcgctccggtttctccggttgacccagtcactcctgttgcaccagttactccagtagctccagtatccccggtcgagccagttggaccggtttctcctgtcgcccctgttactccggttggacctgtcgaccctgttggcccggttggacctgttattccggttgtgccggttgggccggttgttcccgtacccccggttataccagttaccccagtcgctccggttgaaccagtcactcccgttacaccagttgaccctgttgctccggtttctccagttgagccagtcggtccggttattcctgttgacccagttacaccggtcgctccagttactccagttgagcccgttgctccggtttctcctgttggtccagtcacaccggttgggcccgtcgcgccagttggacccgttactccggttgcgccggttgcgccggttgagccagttgagccagtttctccagtttctccagttgcaccggttgagccagttgggcctgtcgatcccgttggaccggtctctcccgttggtccgatttctccagttacccccgttgcccctgttgcgccggtttctcctgtcgctcctgttactccagttgagcccgtggttccggttgagcctgttgatcctgttaaacctgttggccctgttgcgccggttgggcctgtcgatcctgtggcgcctgtttctccagttaatcccgtcgcaccagttgagccggttactcccgttaccccagtcgctcctgtcgatcccgttacaccagttagacccgttactccggtggggccggtttctcccgttgagcctgtcggtccggttgaaccaattgctccggtcgctcctgtcgatcccgttgcaccggttactcctgttgcgccagtcgctcctgttatccccgttgggccggttactccagtagctccggtttccccggtcgagccggtttctccggttgaacccgttgctccgattggaccggtcgctccagttacccccgttgcccctgttgggccggtttctccggttgcacctgttgctccggttgggccagttgatccggttgctccggtttctccagttattcccgttgcaccggttgagccggtttctcccgttgagccagttgagccagtcggtccggttattcctgttgaccctgttacaccggtcgctccagttactccagttgagcccgttgcgccggtttctcctgttgagccagtaacccctgttgagccagtaacccctgttggtccagtcacaccggttggtccggttgggctcgttcccccggttacacccgttaccccagtcgctccggttatccccgttgtgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagtttctcccgttgcaccggttgatcctgttaccccagtcgatcctgtcgatcccgttgcaccggttaatcctgttactcctgttgatccggttactcccgtcgccccggtttctccggttgaaccagttgaccctgttacaccggtcgctccggtttctcctgttgacccagtcactcctgttgaaccagttactccagtagctccagtatccccggtcgagccagttggaccggttactccggttaaaccgattgtgcctgtcgcccctgttacaccagttgggccggttggacctgttattccggttgatcccgttgctcctgttactccagttgagcctgatgagccagtcgcgcctgtttctcctgttactcccgttggaccggttgcaccggtttctcccgttgagcccgtcggtccggttgagcccgttgcccctgttattccggttgaacctgtagatccagttggaccggtctctccagttgcgccgatttctccagttacacccattgcccctgttgggccggttgatcctgtcgatcccgttacccctgttactccggtcgctcccgttacacccgttgcccctgttgggccggttactccagtagctccggtatccccggtcgagccggtttctccggttgcacctgttgctccggttgggccagttgatccggttgcgccagtaactcctgttggaccggttgagccagtcgcgcctgttacccccgttgctccggttgggccggttgttcccgttcccccggttataccagttaccccagtcgctccggttgggccggtttctccggttgaacctgtcactcccgttgaaccagttgaccctgttgatccggttgaacccgttgcccctgttattccggttgagcctgtagatccagttggaccggtcgctccagttgcgccgatttctccagttacacccattgcccctgttgggccggttgatcctgtcgatcccgttacccctgttactccggtcgatcccgttacacccgttgctccggttgatccggttactcccgtcgccccggttgaacccgttgggcctgttacaccagtcgagccggttgttcctgttactccagtcattccggttgctcctgttgagccagtcgcgcctgttacccccgttgctccggttgggccggttgatcccgttattcctgatggtcctattgatccggttataccagttgggcctgtcggtccggttacacccgttactaaattagatatggcggaggaagagggattcgaacccccgcgggctttgacacccctgtcggttttcaagaccgatcccttcagccagacttgggtattcctccgtataagtggtggaccttgtaggactcgaacctacgaccggacggttatgagccgtctgctctaaccaactgagctaaaggtccaatggtagcggcggaggggatcgaacccccgacctcacgggtatgaaccgtacgctctagccagctgagctacaccgccaaaaacaattaaaatcaagtggagcctagcgggatcgaaccgctgacctcctgcgtgcaaagcaggcgctctcccagctgagctaaggccccaaagtggtcgggaagacaggattcgaacctgcgaccccatggtcccaaaccatgtgctctaccaagctgagctacttcccgtttttcaaaagtatgtatggcgcgcccgagaggagtcgaacccctaaccttttgatccgtagtcaaacgctctatccaattgagctacgggcgcaacaataagtgccgagggccggacttgaaccggcacggtagtcacctaccgcaggattttaagtcctgtgtgtctgccaattccaccaccccggcatggatggtatagtatagttggagcggaagacgggattcgaacccgcgacccccaccttggcaaggtgatgttctaccactgaactacttccgcgtttggcaatgcggatgaagggacttgaacccccacgtctgtaaagacactagagcctgattctagcgcgtctgccaattccgccacatccgcaagaaaaacatggtgagccatgaaggactcgaaccttcgaccctctgattaaaagtcagatgctctaccaactgagctaatggctcttattacaagagacttatatagtataacatataaaagtggtgccggcaagaggacttgaacccccaacctactgattacaagtcagttgctctaccaattgagctacaccggcctaatacgccaacttatgtatgataggaatggtggaggatgacgggctcgaaccgccgaccctctgcttgtaaggcagatgctctcccagctgagctaatcctccgtatattacacttacgtgtaatgtcactttctaaagcaactttttaagtatataataagtttctcttaaagtcaacatgttttttttataaatggtggagcctagcgggatcgaaccgctgacctcctgcgtgcaaagcaggcgctctcccagctgagctaaggccccgaagtggtcgggaagacaggattcgaacctgcgaccccatggtcccaaaccatgtgctctaccaagctgagctacttcccgatttttaaaaatattatggcgcgcccgagaggagtcgaacccctaaccttttgatccgtagtcaaacgctctatccaattgagctacgggcgcataataatgaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcatacaggataactatcctgtataatgcgggtgaagggacttgaacccccacgtcataagacactagatcctaagtctagcgcgtctgccaattccgccacacccgcgtaacatggtgagccatgaaggactcgaaccttcgaccctctgattaaaagtcagatgctctaccaactgagctaatggctctttttaaaagacttgtgttattatcttgtccaaaaatggtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccgtatattacacttacgtgtaatatttttattttatctaccatgtttttgtttatgaagcttataatattccgcagtagctcagtggtagagctatcggctgttaaccgatcggtcgtaggttcgagtcctacctgcggagccattgcttccatagctcagcaggtagagcacttccatggtaaggaagaggtcagcggttcgagcccgcttggaagcttatctaaaatacgttgatctgaagcagtttccgaatgttatggaactgttattttttgtttagttcagtaaaaacctgatgctgattgtaccagttaaggtataggtatttagcgcgtctcctgatgaagcctttcttcaaggatgcaaaagagattaacataattaattgttaaacggtattgacttttatcaaaaccttgatataattacttttgtcataatgaacagtataaataacaatacggtttaccgctatctgaagctgtattctggccatgtattacacttttacttgcggaagtagttcagtggtagaacatcaccttgccaaggtgggggtcgcgggttcgaatcccgtcttccgctccattttatcccaacgggatattgttgaaattgattgcgcccgtagctcaattggatagagcgtttgactacggatcaaaaggttaggggttcgactcctctcgggcgcgccataatattttttaaaatcgggaagtagctcagcttggtagagcacatggtttgggaccatggggtcgcaggttcgaatcctgtcttcccgaccattctcaagctttaaagacaatatactggttttctttttttctctttttttaaaaaaatgcttgatttatagagaagcaccggccggaacgtctcctccagccggctgcggtcaagcgggcccgtcagttccagcacagccggcatattgtagccgacaccgccgtcttcaagctgttggagcacatacatccgtttctgcgctgaggacaccgggtaggtgtcctgtgcttgcgcaggctgaatcgcttcatacgggctttcttccaagtcctgaataaccgaagcgagctcttccaccgtcggccgggcgaagatgtcctgtaacggcacctgaacaccgaactctttggcaatgcgggagacaagagctgtcgcttttaacgaatggccgccccgctcaaaaaagtgatcccggatgccgacggggccgtttttcagcacctcttcccaaagggcgcaaagcttcatttctgtgacgttccgcggggcggtgtacgcctgtctgtctgccgctccgccgggagccggcagcgctcggcggtcaagctttccgctcggcgtgaccggccattcgctcatctctataaactgagccggcatcatgtaggccggaaggcgtgtggcaagctctgcccgcacgtcatcgctttttcgtccttcgatataggcgtaaagcgcggtttcgccgtgttcggtccgggcggtgaccgccgcctcacgaatgccgtcgatgcgccggatcgccgcttcgatttcccccggttcaatccggtagccgcggactttcacctgtccgtctgaacgcccacggtcgttcagacggacaggtgaaagtccgcggctaccggattgaaccgggagaaatcgaagcggcgatccggcgcatcgacggcattcgtgaggcggcagtcaccgctcggaccgaagaaggcgaaaccgcactttacgcctatatcgaaggacgaaaaagcgatggcgtgcgtgcggagcttgccacacgccttccggcctacatgatgccggctcagtttatagagatgagcgaatggccggtcacgccgagcggaaagcttgaccgccgcgcgctgccggctcccggcggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagagagcccgtatgaagcgattcagcctgcgaaaaaacaggacacctacccggtgtcttcagcgcagaaacggatgtatgtgctccaacagcttgaagacggcggtgtcggctacaatatgccggctgtgctggaactgacgggcccgcttgaccgtgtccggctggaggagacgttccgggggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtattttttcgtttgttatgtattgataattagtggcggagagcaagggattcgaacccttgagacggggttaccgcctacacgatttccaatcgtgctccttcggccactcggacagctctccataattggctccgcaggtaggattcgaacctacgaccgatcggttaacagccgatagctctaccactgagctactgcggaatgaagtctgcctggcaatgtcctactctcacagggggaaacccccgactaccatcggcgctgaagagcttaacttccgtgttcggcatgggaacgggtgtgacctcttcgccatcatcaccagacgttttagtgacatgtattattatactatgtatttcagaaaaagcaagagtttttttgaaaaaaaagcttgtggagcggcacgagtcgctcagaacgtcctttgaaacggggcctgacggcgaaccggtgcagcgcatccatgacagcgtaccgtttcagctcgatgaggccgagtcagctgacgcattcgtccggccgttttgtctggaagaagcgccgctcttccgtgcggctctcgtgaaagaatcagacgaacgtcaccttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggttcggctccgttctgatggcaagcgtgttgacgaacatgccgagaatcggttcaaggtctttgtgcgggcgcccggcaatcggcgatccgacgatgatgtcttcctgcccgctcaatcgcgcgagtaacgtattgtacgcggcgagaagcaccatatacaaagtggagccgtgatcccgggcgatgcggtgaaggccggatgccgtttcagcgtcaagcgtgcacgatacgctgccgcccgcaaagcttctgaccgccggacggggcttgtcagccggaagttcaagcaccggaagctctccttctagccgcttcagccaataggcttcctgcttctggtatccagtcactcctgttggaccggttgagccagtcgcgcctgttacccccgttgctccggttgggccggtcgatccggttatccccgtcgccccggttgctcctgtcgatcccgttacaccagtcgatccggtagctccagttactcccgtcgctcctcttgccccggttgaaccaattgctccggtcgatcctgttgcccctgttattccggttgagcctgttgatccggttggaccggcctctcccgttggaccggtcgctcctgctgctccagtcactcccgttgcaccagtcactcctgttggcacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggtccaacaggagtgactggtgcaacgggagtgactggagcagcaggagaggccggtccaaccggatcaacaggctcaaccggaataacaggctcaaccggaataacaggggcaacaggatcgaccggagcaattggttcaaccggggcaagaggagcgacgggagtaactggagctaccggatcgactggtgtaacgggatcgaccggagcaaccggggcgacggggataaccggatcgaccggcccaaccggagcaacgggggtaacaggcgcgactggctcaaccggtattatcatcgcggggtggagcagttcggtagctcgtcgggctcataacccgaaggtcgcaggttcaaatcctgcccccgcaaccaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttggttttgaaggaactttgattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgccccagtcactcctgttggacccgttacacccgttaggcctgttgtacctgttactccagttgacccggttgctcctgttgatcccgttactccggttgcaccggttgatccagttgggcctgtcgatcccgttggaccgatttctccagttacccccgttgcccctgttgcgccggttgggcccccggggctatctgaaccgccctgagctgacggaggagcgctttgtcgttgatccgttttatccgggagaacgcatgtatcagacgggcgatatcgcacgctggacagaagacggccttgtcgaatggctgcttggcggcgtcctactctcacagggggaaacccccgactaccatcggcgctgaagagcttaacttccgtgttcggcatgggaacgggtgtgacctcttcgctatcgccaccaaaccattgagagtgtccatgaaccaggatgacaccgtgctgaaaatcccttgaatcgtcgtccacgcattcacgatatttgaccagatgcttgtcgccactccggcgacagctgatgaaaccggcgtccatacatttttcctcagccttacgctgttcctcgatctcagcttgacgcttggcttcttcctcagccttacgctgttcctcgatctcagcttgacgcttggcttcttcctcagccttacgctgttc
